United States Patent
Evans et al.

(10) Patent No.: US 11,613,566 B2
(45) Date of Patent: Mar. 28, 2023

(54) VARIANT ICOS LIGAND IMMUNOMODULATORY PROTEINS AND RELATED COMPOSITIONS AND METHODS

(71) Applicant: Alpine Immune Sciences, Inc., Seattle, WA (US)

(72) Inventors: Lawrence Evans, Seattle, WA (US); Michael Kornacker, Seattle, WA (US); Ryan Swanson, Seattle, WA (US)

(73) Assignee: Alpine Immune Sciences, Inc., Seattle, WA (US)

( * ) Notice: Subject to any disclaimer, the term of this patent is extended or adjusted under 35 U.S.C. 154(b) by 0 days.

(21) Appl. No.: 17/560,209

(22) Filed: Dec. 22, 2021

(65) Prior Publication Data
US 2022/0112265 A1   Apr. 14, 2022

Related U.S. Application Data

(63) Continuation of application No. 16/757,344, filed as application No. PCT/US2018/056381 on Oct. 17, 2018, now abandoned.

(60) Provisional application No. 62/574,161, filed on Oct. 18, 2017.

(51) Int. Cl.
| | |
|---|---|
| C07K 14/705 | (2006.01) |
| A61K 35/54 | (2015.01) |
| A61K 38/17 | (2006.01) |
| C12N 5/071 | (2010.01) |
| C12N 15/85 | (2006.01) |
| C12P 21/02 | (2006.01) |

(52) U.S. Cl.
CPC ........ *C07K 14/70532* (2013.01); *A61K 35/54* (2013.01); *A61K 38/1774* (2013.01); *C12N 5/0681* (2013.01); *C12N 15/85* (2013.01); *C12P 21/02* (2013.01); *C07K 2319/02* (2013.01); *C07K 2319/03* (2013.01); *C07K 2319/21* (2013.01); *C07K 2319/30* (2013.01); *C07K 2319/31* (2013.01); *C07K 2319/41* (2013.01); *C07K 2319/43* (2013.01)

(58) Field of Classification Search
None
See application file for complete search history.

(56) References Cited

U.S. PATENT DOCUMENTS

| | | | |
|---|---|---|---|
| 5,168,062 A | 12/1992 | Stinski | |
| 5,208,020 A | 5/1993 | Chari et al. | |
| 5,385,839 A | 1/1995 | Stinski | |
| 5,443,964 A | 8/1995 | Pickup et al. | |
| 5,457,035 A | 10/1995 | Baum et al. | |
| 5,500,362 A | 3/1996 | Robinson et al. | |
| 5,624,821 A | 4/1997 | Winter et al. | |
| 5,648,260 A | 7/1997 | Winter et al. | |
| 5,698,530 A | 12/1997 | Schlom et al. | |
| 5,716,613 A | 2/1998 | Guber et al. | |
| 5,716,826 A | 2/1998 | Guber et al. | |
| 5,731,168 A | 3/1998 | Carter et al. | |
| 5,767,071 A | 6/1998 | Palladino et al. | |
| 5,780,426 A | 7/1998 | Palladino et al. | |
| 5,821,337 A | 10/1998 | Carter et al. | |
| 5,851,529 A | 12/1998 | Guber et al. | |
| 5,891,432 A | 4/1999 | Hoo | |
| 5,998,205 A | 12/1999 | Hallenbeck et al. | |
| 6,143,290 A | 11/2000 | Zhang et al. | |
| 6,194,551 B1 | 2/2001 | Idusogie et al. | |
| 6,365,619 B1 | 4/2002 | Shi | |
| 6,428,968 B1 | 8/2002 | Molnar-Kimber et al. | |
| 6,596,535 B1 | 7/2003 | Carter | |
| 6,632,670 B1 | 10/2003 | Wadsworth et al. | |
| 6,635,472 B1 | 10/2003 | Lauermann | |
| 6,635,750 B1 | 10/2003 | Coyle et al. | |
| 6,653,103 B2 | 11/2003 | Peterson et al. | |
| 6,689,871 B1 | 2/2004 | Wolfe et al. | |
| 6,723,316 B2 | 4/2004 | Laguerre et al. | |
| 6,737,056 B1 | 5/2004 | Presta | |
| 6,855,317 B2 | 2/2005 | Koelle et al. | |
| 6,887,471 B1 | 5/2005 | Linsley et al. | |
| 6,897,045 B2 | 5/2005 | Engelhardt et al. | |
| 6,936,257 B1 | 8/2005 | Bennett | |
| 6,998,252 B1 | 2/2006 | Moss et al. | |
| 7,001,765 B2 | 2/2006 | Maass et al. | |
| 7,033,826 B2 | 4/2006 | Perricaudet et al. | |
| 7,094,875 B2 | 8/2006 | Punnonen et al. | |
| 7,125,717 B2 | 10/2006 | Carter | |
| 7,153,510 B1 | 12/2006 | Rose | |
| 7,172,893 B2 | 2/2007 | Rabinowitz et al. | |

(Continued)

FOREIGN PATENT DOCUMENTS

| | | |
|---|---|---|
| EP | 0757099 | 2/1997 |
| EP | 1385466 | 2/2004 |

(Continued)

OTHER PUBLICATIONS

U.S. Appl. No. 17/707,511, filed Mar. 29, 2022, by Swanson et al.
U.S. Appl. No. 16/959,662, filed Jan. 3, 2019, by Swanson et al.
U.S. Appl. No. 17/252,233, filed Dec. 14, 2020, by Swanson et al.
U.S. Appl. No. 17/603,827, filed Apr. 16, 2020, by Swanson et al.
"Database accession No. A0A2K5E9H6," Retrieved from UNIPROT, https://www.uniprot.org/uniprot/A0A2K5E9H6. Retrieved Sep. 13, 2019.
"Database accession No. AER57743 Human B7Rp1 extracellular domain (ECD)" Dated Apr. 19, 2007.
"Database accession No. BDH56778", Retrieved from GENESEQ, Retrieved on Sep. 13, 2019.

(Continued)

*Primary Examiner* — Michael D Pak
(74) *Attorney, Agent, or Firm* — Morrison & Foerster, LLP

(57) ABSTRACT

Provided herein are immunomodulatory proteins comprising ICOSL variants and nucleic acids encoding such proteins. The immunomodulatory proteins provide therapeutic utility for a variety of immunological and oncological conditions. Compositions and methods for making and using such proteins are provided.

4 Claims, 83 Drawing Sheets

Specification includes a Sequence Listing.

(56) References Cited

U.S. PATENT DOCUMENTS

| | | |
|---|---|---|
| 7,238,526 B2 | 7/2007 | Wilson et al. |
| 7,241,447 B1 | 7/2007 | Engelhardt et al. |
| 7,247,615 B2 | 7/2007 | Schlom et al. |
| 7,332,581 B2 | 2/2008 | Presta |
| 7,368,116 B2 | 5/2008 | Schlom et al. |
| 7,371,826 B2 | 5/2008 | Presta |
| 7,378,087 B2 | 5/2008 | Jefferies et al. |
| 7,521,532 B2 | 4/2009 | Dunussi-Joannopoulos et al. |
| 7,537,924 B2 | 5/2009 | Coffin |
| 7,550,296 B2 | 6/2009 | Hermiston et al. |
| 7,588,767 B2 | 9/2009 | Szalay et al. |
| 7,588,771 B2 | 9/2009 | Szalay et al. |
| 7,662,398 B2 | 2/2010 | Szalay et al. |
| 7,662,627 B2 | 2/2010 | Johnson et al. |
| 7,731,952 B2 | 6/2010 | Mohr et al. |
| 7,731,974 B2 | 6/2010 | Bell et al. |
| 7,754,221 B2 | 7/2010 | Szalay et al. |
| 7,811,814 B2 | 10/2010 | Bohn et al. |
| 7,897,146 B2 | 3/2011 | Brown et al. |
| 7,906,111 B2 | 3/2011 | Wilson et al. |
| 7,927,585 B2 | 4/2011 | Snyder |
| 7,943,374 B2 | 5/2011 | Hildinger |
| 7,968,340 B2 | 6/2011 | Hallek et al. |
| 8,007,780 B2 | 8/2011 | Arbetman et al. |
| 8,624,010 B1 | 1/2014 | Yoshinaga |
| 8,709,417 B2 | 4/2014 | Allison et al. |
| 8,911,726 B2 | 12/2014 | Takahashi et al. |
| 9,103,831 B2 | 8/2015 | O'Sullivan et al. |
| 9,375,475 B2 | 6/2016 | Allison et al. |
| 9,453,227 B2 | 9/2016 | Diamond et al. |
| 10,858,451 B2 | 12/2020 | Bernett et al. |
| 10,882,914 B2 | 1/2021 | Swanson et al. |
| 11,078,282 B2 | 8/2021 | Swanson et al. |
| 2002/0009454 A1 | 1/2002 | Boone et al. |
| 2002/0168714 A1 | 11/2002 | Barbas et al. |
| 2003/0083246 A1 | 5/2003 | Cohen et al. |
| 2003/0138881 A1 | 7/2003 | Punnonen et al. |
| 2003/0158102 A1 | 8/2003 | Chen et al. |
| 2004/0063094 A1 | 4/2004 | Coffin et al. |
| 2004/0072283 A1 | 4/2004 | Seed et al. |
| 2004/0146488 A1 | 7/2004 | Hu et al. |
| 2005/0014934 A1 | 1/2005 | Hinton et al. |
| 2007/0202572 A1 | 8/2007 | Szalay et al. |
| 2007/0212727 A1 | 9/2007 | Szalay et al. |
| 2009/0053244 A1 | 2/2009 | Chen et al. |
| 2009/0098529 A1 | 4/2009 | Chen et al. |
| 2009/0117034 A1 | 5/2009 | Chen et al. |
| 2009/0136917 A1 | 5/2009 | Szalay et al. |
| 2009/0155287 A1 | 6/2009 | Chen et al. |
| 2009/0162288 A1 | 6/2009 | Chen et al. |
| 2009/0252749 A1 | 10/2009 | Leister et al. |
| 2009/0258031 A1 | 10/2009 | Karrer et al. |
| 2010/0062016 A1 | 3/2010 | Szalay et al. |
| 2010/0178276 A1 | 7/2010 | Sadelain et al. |
| 2010/0196325 A1 | 8/2010 | Szalay et al. |
| 2010/0233078 A1 | 9/2010 | Szalay et al. |
| 2010/0261660 A1 | 10/2010 | Punnonen et al. |
| 2011/0064650 A1 | 3/2011 | Szalay |
| 2011/0293705 A1 | 12/2011 | Irvine et al. |
| 2013/0149305 A1 | 6/2013 | Ostrand-Rosenberg |
| 2013/0287748 A1 | 10/2013 | June et al. |
| 2014/0050708 A1 | 2/2014 | Powell et al. |
| 2014/0099309 A1 | 4/2014 | Powell et al. |
| 2014/0154216 A1 | 6/2014 | Coffin |
| 2014/0170141 A1 | 6/2014 | Toporik et al. |
| 2014/0186380 A1 | 7/2014 | Gurney |
| 2014/0186401 A1 | 7/2014 | Diamond et al. |
| 2014/0227237 A1 | 8/2014 | June et al. |
| 2014/0322129 A1 | 10/2014 | Leong et al. |
| 2014/0348832 A1 | 11/2014 | Zhu et al. |
| 2015/0104451 A1 | 4/2015 | Orban |
| 2015/0232532 A1 | 8/2015 | Ostrand-Rosenberg |
| 2015/0359909 A1 | 12/2015 | O'Sullivan et al. |
| 2016/0017018 A1 | 1/2016 | Wang et al. |
| 2016/0017041 A1 | 1/2016 | Violette et al. |
| 2016/0145344 A1 | 5/2016 | Akbari |
| 2016/0158318 A1 | 6/2016 | Cohen et al. |
| 2016/0244524 A1 | 8/2016 | Allison et al. |
| 2016/0264643 A1 | 9/2016 | Lazar et al. |
| 2016/0271218 A1 | 9/2016 | Biro |
| 2016/0340422 A1 | 11/2016 | Chen et al. |
| 2017/0028040 A1 | 2/2017 | Lan et al. |
| 2017/0042972 A1 | 2/2017 | Karyekar |
| 2017/0369549 A1 | 12/2017 | Peach et al. |
| 2018/0244749 A1 | 8/2018 | Swanson et al. |
| 2018/0256644 A1 | 9/2018 | Swanson et al. |
| 2020/0040059 A1 | 2/2020 | Swanson et al. |
| 2021/0139606 A1* | 5/2021 | Kontermann ........ C07K 14/435 |
| 2021/0188995 A1 | 6/2021 | Swanson et al. |
| 2021/0363219 A1 | 11/2021 | Swanson et al. |
| 2022/0218785 A1 | 7/2022 | Swanson et al. |

FOREIGN PATENT DOCUMENTS

| | | |
|---|---|---|
| EP | 1391213 | 2/2004 |
| EP | 1520175 | 4/2005 |
| EP | 1606411 | 12/2005 |
| EP | 1870459 | 12/2007 |
| EP | 3020816 | 5/2016 |
| JP | 2013-518900 | 5/2013 |
| WO | WO-1993/010151 | 5/1993 |
| WO | WO-1994/011026 | 5/1994 |
| WO | WO-1994/029351 | 12/1994 |
| WO | WO-1998/050431 | 11/1998 |
| WO | WO-1999/038955 | 8/1999 |
| WO | WO-1999/051642 | 10/1999 |
| WO | WO-2000/042072 | 7/2000 |
| WO | WO-2001/030843 | 5/2001 |
| WO | WO-2002/000717 | 1/2002 |
| WO | WO-2004/029197 | 4/2004 |
| WO | WO-2004/056312 | 7/2004 |
| WO | WO-2005/063816 | 7/2005 |
| WO | WO-2005/100402 | 10/2005 |
| WO | WO-2006/019447 | 2/2006 |
| WO | WO-2006/029879 | 3/2006 |
| WO | WO-2007/005874 | 1/2007 |
| WO | WO-2007/052029 | 5/2007 |
| WO | WO-2008/011636 | 1/2008 |
| WO | WO-2008/092117 | 7/2008 |
| WO | WO-2008/155134 | 12/2008 |
| WO | WO-2009/029342 | 3/2009 |
| WO | WO-2009/041613 | 4/2009 |
| WO | WO-2009/067800 | 6/2009 |
| WO | WO-2009/076524 | 6/2009 |
| WO | WO-2010/077634 | 7/2010 |
| WO | WO-2011/020024 | 2/2011 |
| WO | WO-2011/056983 | 5/2011 |
| WO | WO-2011/066389 | 6/2011 |
| WO | WO 2011/097477 | 8/2011 |
| WO | WO-2011/113019 | 9/2011 |
| WO | WO-2011/133886 | 10/2011 |
| WO | WO-2012/079000 | 6/2012 |
| WO | WO-2012/125850 | 9/2012 |
| WO | WO-2012/141984 | 10/2012 |
| WO | WO-2012/149364 | 11/2012 |
| WO | WO-2013/003761 | 1/2013 |
| WO | WO-2013/079174 | 6/2013 |
| WO | WO-2013/130683 | 9/2013 |
| WO | WO-2013/149167 | 10/2013 |
| WO | WO-2013/169338 | 11/2013 |
| WO | WO-2014/089113 | 6/2014 |
| WO | WO-2014/198002 | 12/2014 |
| WO | WO-2014/207063 | 12/2014 |
| WO | WO-2015/009606 | 1/2015 |
| WO | WO-2015/107026 | 7/2015 |
| WO | WO 2015/120363 | 8/2015 |
| WO | WO-2016/008976 | 1/2016 |
| WO | WO-2016/011083 | 1/2016 |
| WO | WO-2016/191643 | 1/2016 |
| WO | WO-2016/022994 | 2/2016 |
| WO | WO 2016/034678 | 3/2016 |
| WO | WO-2016/073704 | 5/2016 |
| WO | WO-2016/118577 | 7/2016 |
| WO | WO 2016/154684 | 10/2016 |

(56) References Cited

FOREIGN PATENT DOCUMENTS

| | | |
|---|---|---|
| WO | WO-2016/164428 | 10/2016 |
| WO | WO-2016/168771 | 10/2016 |
| WO | WO 2017/019846 | 2/2017 |
| WO | WO-2017/023779 | 2/2017 |
| WO | WO-2017/034916 | 3/2017 |
| WO | WO-2017/048878 | 3/2017 |
| WO | WO-2017/055547 | 4/2017 |
| WO | WO-2017/181148 | 10/2017 |
| WO | WO-2017/181152 | 10/2017 |
| WO | WO-2017/201131 | 11/2017 |
| WO | WO-2018/022945 | 2/2018 |
| WO | WO-2018/022946 | 2/2018 |
| WO | WO-2018/075978 | 4/2018 |
| WO | WO-2019/079520 | 4/2019 |
| WO | WO-2019/136179 | 7/2019 |
| WO | WO-2019/241758 | 12/2019 |
| WO | WO-2020/214867 | 10/2020 |

OTHER PUBLICATIONS

"Database accession No. BDV07959," Retrieved from GENESEO, Retrieved on Sep. 12, 2019.

"Database accession No. A0A2J8M811," Retrieved from UNIPROT, https://www.uniprot.org /uniprot/A0A2J8M811. Retrieved on Mar. 5, 2020.

"Database accession No. H9Z6Y0," version 15. Retrieved from UNISAVE, http://www.ebi.ac.uk/uniprot/unisave/app/#/content/H9Z6Y0/15. Retrieved on Jun. 20, 2017.

"Database accession No. L8Y5K4," version 13. Retrieved from UNISAVE, http://www.ebi.ac.uk/uniprot/unisave/app/#/content/L8Y5K4/13. Retrieved on Sep. 28, 2017.

"Database accession No. NP_56074.1," version 1. Retrieved from NCBI, https://www.ncbi.nlm.nih.gov/protein /NP_056074.1, Retrieved on Mar. 3, 2020.

Adler S. et al., "Evaluation of Histologic, Serologic, and Clinical Changes in Response to Abatacept Treatment of Primary Sjögren's Syndrome: A Pilot Study" Arthritis Care and Research vol. 65, No. 11, Nov. 2013, pp. 1862-1868.

Alpine Immune Sciences, Inc., "Alpine Immune Sciences Announces Preclinical Data Showing Novel Immuno-Oncology Costimulatory Molecules Generated from vIgD Platform Fused with Trastuzumab Enhanced Immune Responses Against HER2-Positive Tumor Cells ," Data Presented at 2017 San Antonio Breast Cancer Symposium, Published Dec. 6, 2017, available online at: http://www.businesswire.com/news/home/20171206005074/en/Alpine-Immune-Sciences-Announces-Preclinical-Data-Showing.

Amatore et al., "Inducible Co-Stimulator (ICOS) as a Potential Therapeutic Target for Anti-Cancer Therapy," Expert Opin Ther Targets. (2018) 22(4): 343-351.

Auffermann-Gretzinger et al., "Rapid establishment of dendritic cell chimerism in allogeneic hematopoietic cell transplant recipients," Blood. (2002) 99(4): 1442-1448.

Baban et al., "Bacteria as vectors for gene therapy of cancer," Bioeng Bugs. (2010) 1(6):385-394.

Banovic et al., "Graft-versus-host disease prevents the maturation of plasmacytoid dendritic cells," J Immunol. (2009) 182(2): 912-920.

Benson et al., "GenBank," Nucleic Acids Res (2013) 41 (Database issue):D36-D42.

Bowman S.J., et al., "Randomized Controlled Trial of Rituximab and Cost-Effectiveness Analysis in Treating Fatigue and Oral Dryness in Primary Sj€ogren's Syndrome" Arthiritis and Rheumatology vol. 69, No. 7, Jul. 2017, pp. 1440-1450.

Brown et al., "Structure-based mutagenesis of the human immunodeficiency virus type 1 DNA attachment site: effects on integration and cDNA synthesis," J Virol. (1999) 73(11):9011-9020.

Bruggemann et al., "Comparison of the effector functions of human immunoglobulins using a matched set of chimeric antibodies," J Exp Med. (1987) 166(5):1351-1361.

Buchschacher et al., "Human immunodeficiency virus vectors for inducible expression of foreign genes," J Virol. (1992) 66(5):2731-2739.

Burmeister et al., ICOS controls the pool size of effector-memory and regulatory T cells. J Immunol.(2008) 180:774-82.

Busch et al., "Dimers, leucine zippers and DNA-binding domains," Trends Genet. (1990) 6(2): 36-40.

Cai, B. et al., "C-terminal lysine processing of human immunoglobulin G2 heavy chain in vivo" 2011 Biotechnol Bioeng 108:404-412.

Canfield S.M., "The Binding Affinity of Human IgG for its High Affinity Fc Recepor is Determined by Multiple Amino Acids in the CH2 Domain and is Modulated by the Hinge Region" J. Exp. Med. Vol. 173, Jun. 1991, pp. 483-1491.

Carsons S.E., et al., "Treatment Guidelines for Rheumatologic Manifestations of Sjorgen's Syndrome: Use of Biologic Agents, Management of Fatigue, and Inflammatory Musculoskeletal Pain" Arthritic Care and Research vol. 69, No. 4, Apr. 2017, pp. 517527.

Chang et al., "The discovery of small molecule carbamates as potent dual alpha(4)beta(1)/alpha(4)beta(7) integrin antagonists," Bioorg Med Chem Lett. Jan. 21, 2002;12(2):159-63.

Chari et al., "Immunoconjugates containing novel maytansinoids: promising anticancer drugs," Cancer Res. (1992) 52(1):127-131.

Chattopadhyay et al., "Structural basis of inducible costimulator ligand costimulatory function: determination of the cell surface oligomeric state and functional mapping of the receptor binding site of the protein," J Immunol. Sep. 15, 2006;177(6):3920-9.

Clynes et al., "Fc receptors are required in passive and active immunity to melanoma," Proc Natl Acad Sci U S A. (1998) 95(2):652-656.

Coates L.C., et al., "Group for Research and Assessment of Psoriasis and Psoriatic Arthritis/Outcome Measures in Rheumatology Consensus-Based Recommendations and Research Agenda for Use of Composite Measures and Treatment Targets in Psoriatic Arthritis" Arthritis and Rheumatology, vol. 70, No. 3, Mar. 2018, pp. 345-355.

Colby et al., "Engineering antibody affinity by yeast surface display," Methods Enzymol. 2004;388:348-58.

Colcher et al., "Use of monoclonal antibodies as radiopharmaceuticals for the localization of human carcinoma xenografts in athymic mice," Methods Enzymol. (1986); 121: 802-16.

Condomines et al., "Tumor—Targeted Human T Cells Expressing CD28-Based Chimeric Antigen Receptors Circumvent CTLA-4 Inhibition," PLoS One (2015) 10(6):e0130518.

Cornetta et al., "No retroviremia or pathology in long-term follow-up of monkeys exposed to a murine amphotropic retrovirus," Hum Gene Ther. (1991) Fall;2(3):215-9.

Covassin et al., "Human peripheral blood CD4 T cell-engrafted non-obese diabetic-scid IL2rγ(null) H2-Ab1 (tm1Gru) Tg (human leucocyte antigen D-related 4) mice: a mouse model of human allogeneic graft-versus-host disease," Clin Exp Immunol. 2011 166(2): 269-280.

Cragg et al., "Antibody specificity controls in vivo effector mechanisms of anti-CD20 reagents," Blood. (2004) 103(7):2738-2743.

Cragg et al., "Complement-mediated lysis by anti-CD20 mAb correlates with segregation into lipid rafts," Blood. (2003) 101(3):1045-1052.

Cunha JS, Gilek-Seibert K. "Systemic Lupus Erythematosus: A Review of the Clinical Approach to Diagnosis and Update on Current Targeted Therapies" R I Med J (2013). 2016;99(12):23-27. Published Dec. 1, 2016.

Cutler et al., in *Thomas' Hematopoietic Cell Transplantation*, F. Appelbaum, S. J. Forman, R. S. Negrin, K. G. Blume, Eds. (Blackwell Publishing Ltd, 2009), chap. 86, pp. 1287-1303.

David et al., "Protein iodination with solid state lactoperoxidase," Biochemistry. (1974) Feb. 26;13(5):1014-21.

Deeg et al., "The clinical spectrum of acute graft-versus-host disease," Semin Hematol. (2006) 43(1): 24-31.

Deisenhofer et al., "Crystallographic refinement and atomic models of a human Fc fragment and its complex with fragment B of protein A from *Staphylococcus aureus* at 2.9- and 2.8-A resolution," Biochemistry. Apr. 28, 1981;20(9):2361-70.

(56) References Cited

OTHER PUBLICATIONS

Del Papa N. et al., "Management of primary Sjgren's syndrome: recent developments and new classificiation criteria" Ther Adv Musculoskel Dis 2018, vol. 10(2) 39-54.
Despoix et al., "Mouse CD146/MCAM is a marker of natural killer cell maturation", Eur J Immunol. (2008) 38(10): 2855-2864.
Dick, L. et al., "C-terminal lysine variants in fully human monoclonal antibodies: investigation of test methods and possible causes" 2008 Biotechnol Bioeng 100:1132-1143.
Dillon et al., "A Dual ICOS/CD28 Antagonist ICOSL Variant Ig Domain (vIgDTM) Potently Suppresses Mouse Collagen-Induced Arthritis and Human Xenograft GVHD ," Abstract for 2017 ACR/ARHP Annual Meeting. Arthritis Rheumatol (2017) 69(suppl 10) Abstract No. 1328 (Nov. 3-8, 2017) Published Sep. 2017.
Dillon et al., "A Dual ICOS/CD28 Antagonist ICOSL Variant Ig Domain (vIgDTM) Potently Suppresses Mouse Collagen-Induced Arthritis and Human Xenograft GVHD ," Presentation for 2017 ACR/ARHP Annual Meeting (Nov. 3-8, 2017).
Dillon et al., "Therapeutic Candidate ALPN-101, a Dual ICOS/CD28 Antagonist, Potently Suppresses Human/NSG Mouse Xenograft Graft vs. Host Disease (GvHD) in a Dose Ranging Study and Reduces Disease Activity in a Mouse Model of Hemophagocytic Lymphohistiocytosis (HLH)" Abstract ASH Dec. 1-4, 2018 Published Nov. 1, 2018.
Dillon et al., "Therapeutic Candidate ALPN-101, a Dual ICOS/CD28 Antagonist, Potently Suppresses Human/NSG Mouse Xenograft Graft vs. Host Disease (GvHD) in a Dose Ranging Study and Reduces Disease Activity in a Mouse Model of Hemophagocytic Lymphohistiocytosis (HLH)" Presentation ASH Dec. 1-4, 2018.
Dillon et al., "A Dual ICOS/CD28 Antagonist ICOSL Variant Ig Domain (vIgDTM) Potently Suppresses Human Mixed Lymphocyte Reactions and Human/NSG Mouse Xenograft Graft vs. Host Disease (GvHD)," Abstract for 2018 BMT Tandem Meetings, Salt Lake City, (Feb. 21-25, 2018) Published Jan. 2018.
Dillon et al., "A Dual ICOS/CD28 Antagonist ICOSL Variant Ig Domain (vIgDTM) Potently Suppresses Human Mixed Lymphocyte Reactions and Human/NSG Mouse Xenograft Graft vs. Host Disease (GvHD)" Presentation for BMT Tandem Meetings (ASBMT), Salt Lake City, UT, Feb. 21-25, 2018, 1 page.
Dillon et al., "Therapeutic Candidate ALPN-101, a Dual ICOS/CD28 Antagonist, Demonstrates In Vivo Efficacy in an Experimental Autoimmune Encephalomyelitis (EAE) Model" Abstract for the American Neurological Association Annual Meeting (ANA2018) Atlanta, Georgia, Oct. 20-23, 2018, 1 page Published Oct. 2018.
Dillon et al., "Therapeutic Candidate ALPN-101, a Dual ICOS/CD28 Antagonist, Demonstrates In Vivo Efficacy in an Experimental Autoimmune Encephalomyelitis (EAE) Model" Presentation for the American Neurological Association Annual Meeting (ANA2018) Atlanta, Georgia, Oct. 20-23, 2018, 1 page.
Duncan et al., "The binding site for C1q on IgG," Nature. (1988) Apr. 21;332(6166):738-40.
Duncan, A.R., et al., "Localization of the binding site for the human high-affinity Fc receptor on IgG" 1988 Nature 332:563.
Ehx et al., "Xenogeneic Graft-Versus-Host Disease in Humanized NSG and NSG-HLA-A2/HHD Mice", Front Immunol. (2018) 9:1943.
Elyoussfi S., et al., "Tailored treatment options for patients with psoriatic arthritis and psoriasis: review of established and new biologic and small molecule therapies" Rheumatol Int (2016) 36:603-612.
Engelman et al., "Multiple effects of mutations in human immunodeficiency virus type 1 integrase on viral replication," J Virol. 1995 69(5):2729-2736.
Ettinger R., et al., "Disrupted splenic architecture, but normal lymph node development in mice expressing a soluble lymphotoxin-b receptor-IgG1 fusion protein" Proc. Natl. Acad. Sci. USA, vol. 93, pp. 13102-13107, Nov. 1996 Immunologu.
Evans et al., "Generation of Novel Immuno-Oncology Biologies via Directed Evolution of Variant IgSF Domains," Poster Presentation for Immune Checkpoint Inhibitors, Boston, MA (Mar. 14-16, 2017) 1 page.
Evans et al., "Novel immunomodulatory proteins generated via directed evolution of variant IgSF domains," Abstract for AAI Immunology 2017, Washington D.C. (May 12-16, 2017) 1 page Published April A852017.
Evans et al., "Novel immunomodulatory proteins generated via directed evolution of variant IgSF domains," Poster for AAI Immunology 2017, Washington D.C. (May 12-16, 2017) 1 page.
Evans et al., "Therapeutic T Cell Activation Using Engineered Variant IgSF Domains," Abstract for Society for Immunotherapy of Cancer, National Harbor, MD, (Nov. 9-13, 2016) 1 page Published Nov. 8, 2016.
Evans et al., "Therapeutic T Cell Activation Using Engineered Variant IgSF Domains," Poster presented at Society for Immunotherapy of Cancer, National Harbor, MD, (Nov. 9-13, 2016) 1 page.
Ferrara et al., "Regenerating islet-derived 3-alpha is a biomarker of gastrointestinal graft-versus-host disease," Blood. (2011) 118(25): 6702-6708.
Ferro F, et al., "One year in review 2017: primary Sogren's syndrome" Clin Exp Rheumatol 2017; 35: 179-191.
Forcade et al., "An activated Th17-prone T cell subset involved in chronic graft-versus-host disease sensitive to pharmacological inhibition," JCI Insight. (2017) 2(12): e92111.
Ford et al., "Targeting co-stimulatory pathways: transplantation and autoimmunity," Nat Rev Nephrol. (2014) 10(1):14-24.
Fowler et al., "R707, a fully human antibody directed against CC-chemokine receptor 7, attenuates xenogeneic acute graft-versus-host disease", Am J Transplant. (2019) 19(7): 1941-1954.
Fraker et al., "Protein and cell membrane iodinations with a sparingly soluble chloroamide, 1,3,4,6-tetrachloro-3a,6a-diphrenylglycoluril," Biochem Biophys Res Commun. Feb. 28, 1978;80(4):849-57.
Freeman et al., "Engagement of the PD-1 immunoinhibitory receptor by a novel B7 family member leads to negative regulation of lymphocyte activation," J Exp Med (2000) 192(7):1027-1034.
Garcia-Aragoncillo et al., "Design of virotherapy for effective tumor treatment," Curr Opin Mol Ther. Aug. 2010;12(4):403-11.
Gazzano-Santoro et al., "A non-radioactive complement-dependent cytotoxicity assay for anti-CD20 monoclonal antibody," J Immunol Methods. Mar. 28, 1997;202(2):163-71.
Gentz et al., "Parallel association of Fos and Jun leucine zippers juxtaposes DNA binding domains," Science. (1989) 243(4899): 1695-1699.
Gherardi et al., "Recombinant poxviruses as mucosal vaccine vectors," J Gen Virol. (2005) 86(Pt 11):2925-2936.
Gordon, C, et al., "The British Society for Rheumatology guideline for the management of systemic lupus erythematosus in adults" Rheumatology 2018; 57:e1-e45 advanced publication Oct. 6, 2017.
Guerra et al., "Host response to the attenuated poxvirus vector NYVAC: upregulation of apoptotic genes and NF-kappaB-responsive genes in infected HeLa cells," J Virol. (2006) 80(2): 985-98.
Hahn H.H. et al., "American College of Rheumatology Guidelines for Screening, Case Definition, Treatment and Management of Lupus Nephritis" Arthritis Care Res. (Hoboken). Jun. 2012; 64(6): 797-808.
Hallden et al., "Oncolytic virotherapy with modified adenoviruses and novel therapeutic targets," Expert Opin Ther Targets. Oct. 2012;16(10):945-58.
Harris et al., "CD80 costimulation is essential for the induction of airway eosinophilia," J Exp Med. Jan. 6, 1997;185(1):177-82.
Harris, R. J. "Processing of C-terminal lysine and arginine residues of proteins isolated from mammalian cell culture" 1995 J Chromatogr A 705:129-34.
Hartwell et al., "An early-biomarker algorithm predicts lethal graft-versus-host disease and survival," JCI Insight. (2017) 2(3): e89798.
Hellstrom et al., "Antitumor effects of L6, an IgG2a antibody that reacts with most human carcinomas," Proc Natl Acad Sci U S A. (1986) 83(18):7059-7063.
Hellstrom et al., "Strong antitumor activities of IgG3 antibodies to a human melanoma-associated ganglioside," Proc Natl Acad Sci U S A. (1985) 82(5):1499-1502.

(56) References Cited

OTHER PUBLICATIONS

Hinman et al., "Preparation and characterization of monoclonal antibody conjugates of the calicheamicins: a novel and potent family of antitumor antibiotics," Cancer Res. (1993) 53(14):3336-3342.
Holdgate N et al., "Recent advances in primary Sjogren's syndrome" [version 1; referees: 3 approved]F1000Research 2016, 5(F1000 Faculty Rev):1412 Last updated: Jun. 17, 2016.
Hoseini et al., "A potent tetravalent T-cell-engaging bispecific antibody against CD33 in acute myeloid leukemia", Blood Adv. Jun. 12, 2018;2(11):1250-1258.
Hu et al., "Yaba-like disease virus: an alternative replicating poxvirus vector for cancer gene therapy," J Virol. (2001) 75(21):10300-10308.
Hunter et al., "Preparation of iodine-131 labelled human growth hormone of high specific activity," Nature. May 5, 1962;194:495-6.
Idusogie et al., "Mapping of the C1q binding site on rituxan, a chimeric antibody with a human IgG1 Fc," J Immunol. (2000) 164(8):4178-4184.
Johann et al., "GLVR1, a receptor for gibbon ape leukemia virus, is homologous to a phosphate permease of Neurospora crassa and is expressed at high levels in the brain and thymus," J Virol. (1992) 66(3):1635-1640.
Kabat et al., "Sequences of Proteins of Immunological Interest," Fifth Edition, U.S. Department of Health and Human Services, NIH Publication No. 91-3242 (1991), 83 pages.
Kawalec P, et al., "Comparative effectiveness of abatacept, apremilast, secukinumab and ustekinumab treatment of psoriatic arthritis: a systematic review and network meta-analysis" Rheumatology International (2018) 38:189-201.
Kirn et al., "Targeted and armed oncolytic poxviruses: a novel multi-mechanistic therapeutic class for cancer," Nat Rev Cancer. Jan. 2009;9(1):64-71.
Kolberg, "Gene-transfer virus contaminant linked to monkey's cancer," J NIH Res. (1992) 4:43-44.
Koura et al., "In vivo T cell costimulation blockade with abatacept for acute graft-versus-host disease prevention: a first-in-disease trial", Biol Blood Marrow Transplant. (2013) 19(11): 1638-1649.
Koyama et al., "Plasmacytoid dendritic cells prime alloreactive T cells to mediate graft-versus-host disease as antigen-presenting cells," Blood. (2009) 113(9): 2088-2095.
La Paglia G.M.C. et al., "One year in review 2017: systemic lupus erythematosus" Clin Exp Rheumatol 2017; 35:551-561.
Labrijn et al., "Therapeutic IgG4 antibodies engage in Fab-arm exchange with endogenous human IgG4 in vivo," Nat Biotechnol. Aug. 2009;27(8):767-71.
Laouar et al., "STAT3 is required for Flt3L-dependent dendritic cell differentiation," Immunity. (2003) 19(6): 903-912.
Larsen et al., "Rational development of LEA29Y (belatacept), a high-affinity variant of CTLA4-Ig with potent immunosuppressive properties," Am J Transplant. Mar. 2005;5(3):443-53.
Levin et al., "Novel Immunomodulatory Proteins Generated Via Directed Evolution of Variant IgSF Domains," Abstract for Keystone Symposia: Immune Regulation in Autoimmunity and Cancer, Whistler, British Columbia, Canada (Mar. 26-30, 2017), 1 page Available to Attendees Feb. 26, 2017.
Levin et al., "Novel Immunomodulatory Proteins Generated Via Directed Evolution of Variant IgSF Domains," Poster presentation for Keystone Symposia: Immune Regulation in Autoimmunity and Cancer, Whistler, British Columbia, Canada (Mar. 26-30, 2017), 1 page.
Levin et al., "Novel Variant Ig Domain (vIgD) Proteins Generated Via Directed Evolution of IgSF Domains Have Therapeutic Efficacy in Animal Models of Graft Versus Host Disease," Abstract for ASH 2017 Nov. 1, 2017 (Dec. 9-12, 2017).
Levin et al., "Novel Variant Ig Domain (vIgD) Proteins Generated Via Directed Evolution of IgSF Domains Have Therapeutic Efficacy in Animal Models of Graft Versus Host Disease," Poster for ASH 2017 (Dec. 9-12, 2017).
Levin et al., "Tumor-Localizing NKp30/ICOSL vIgD Fusion Proteins Direct Effective Dual CD28/ICOS T cell Costimulation to B7-H6+ Tumor Cells in vitro and Tumors in vivo" Abstract 2018 SITC (Nov. 7-11, 2018) Published Nov. 6, 2018.
Levin et al., "Tumor-Localizing NKp30/ICOSL vIgD Fusion Proteins Direct Effective Dual CD28/ICOS T cell Costimulation to B7-H6+ Tumor Cells in vitro and Tumors in vivo" Poster 2018 SITC (Nov. 7-11, 2018) Published Nov. 6, 2018.
Levin et al., "Novel Immunomodulatory Proteins Generated Via Directed Evolution of Variant IgSF Domains" Keystone Symposia on Molecular and Cellular Biology, Lymphocytes and their Roles in Cancer, Keystone, CO, Feb. 11-15, 2018, 1 page, presentation.
Levin, S.D., et al., "Novel Immunomodulatory proteins generated via directed evolution of variant IgSF domains." Front Immunol., (2020) 10:3086.
Lewis et al., "Novel immunomodulatory proteins generated via directed evolution of variant IgSF domains," Abstract for Poster Presentation at the Federation of Clinical Immunology Societies Meeting, Chicago IL (Jun. 14, 2017) 2 pages Published after Apr. 7, 2017.
Lewis et al., "Novel immunomodulatory proteins generated via directed evolution of variant IgSF domains," Poster Presentation at the Federation of Clinical Immunology Societies Meeting, Chicago IL (Jun. 14, 2017).
Li et al., "Comparison of anti-CD3 and anti-CD28-coated beads with soluble anti-CD3 for expanding human T cells: differing impact on CD8 T cell phenotype and responsiveness to restimulation," J Transl Med. (2010) 8:104.
Li et al., "Structure of the human activating natural cytotoxicity receptor NKp30 bound to its tumor cell ligand B7-H6," J Exp Med (2011) 208(4): 703-714.
Li et al., "Proteomics analysis reveals a Th17-prone cell population in presymptomatic graft-versus-host disease," JCI Insight. (2016) 1(6): e86660.
Lin et al., "Specific and dual antagonists of alpha(4)beta(1) and alpha(4)beta(7) integrins," Bioorg Med Chem Lett. Jan. 21, 2022;12(2):133-6.
Linsley et al., "Human B7-1 (CD80) and B7-2 (CD86) bind with similar avidities but distinct kinetics to CD28 and CTLA-4 receptors," Immunity. (1994) 1(9): 793-801.
Liu et al., "Eradication of large colon tumor xenografts by targeted delivery of maytansinoids," Proc Natl Acad Sci U S A. (1996) 93(16):8618-8623.
Lode et al., "Targeted therapy with a novel enediyene antibiotic calicheamicin theta(1) 1 effectively suppresses growth and dissemination of liver metastases in a syngeneic model of murine neuroblastoma," Cancer Res. (1998) 58(14):2925-2928.
Lundqvist et al., "31st Annual Meeting and Associated Programs of the Society for Immunotherapy of Cancer (SITC 2016): part one," J Immunother Cancer, (2016) 4(Suppl 1):82.
Lundqvist et al., "31st Annual Meeting and Associated Programs of the Society for Immunotherapy of Cancer (SITC 2016): part two," J Immunother Cancer, (2016) 4(Suppl 1):82.
Mahmood F. et al., "Current concepts and unmet needs in psoriatic arthritis" Clinical Rheumatology vol. 37, pp. 297-305(2018).
Mandler et al., "Immunoconjugates of geldanamycin and anti-HER2 monoclonal antibodies: antiproliferative activity on human breast carcinoma cell lines," J Natl Cancer Inst. Oct. 4, 2000;92(19):1573-81.
Mandler et al., "Modifications in synthesis strategy improve the yield and efficacy of geldanamycin-herceptin immunoconjugates," Bioconjug Chem. Jul.-Aug. 2002;13(4):786-91.
Mandler et al., "Synthesis and evaluation of antiproliferative activity of a geldanamycin-Herceptin immunoconjugate," Bioorg Med Chem Lett. May 15, 2000;10(10):1025-8.
Markey et al., "Conventional dendritic cells are the critical donor APC presenting alloantigen after experimental bone marrow transplantation", Blood. 2009 113(22): 5644-5649.
Markey et al., "Recipient plasmacytoid DCs are not required to prime allogeneic T-cell Yesponses after BMT," Blood. (2009) 113(23): 6038-6039.
Markey et al., "Flt-3L Expansion of Recipient CD8α+ Dendritic Cells Deletes Alloreactive Donor T Cells and Represents an Alter-

(56) References Cited

OTHER PUBLICATIONS native to Posttransplant Cyclophosphamide for the Prevention of GVHD", Clin Cancer Res. (2018) 24(7): 1604-1616.

Martin et al., "Increasingly frequent diagnosis of acute gastrointestinal graft-versus-host disease after allogeneic hematopoietic cell transplantation," Biol Blood Marrow Transplant. (2004) 10(5): 320-327.

Matte et al., "Donor APCs are required for maximal GVHD but not for GVL", Nat Med. (2004) 10(9): 987-992.

Maute et al., "Engineering high-affinity PD-1 variants for optimized immunotherapy and immuno-PET imaging," Proc Natl Acad Sci U S A. (2015) 112(47): E6506-14.

Mayr et al., "Passage history, properties, and applicability of the attenuated vaccinia virus strain MVA," Infection. (1975);3:6-14. (English translation of abstract provided).

McDonald et al., "Plasma biomarkers of acute GVHD and nonrelapse mortality: predictive value of measurements before GVHD onset and treatment," Blood. (2015) 126(1): 113-120.

McLoughlin et al., "TNFerade, an adenovector carrying the transgene for human tumor necrosis factor alpha, for patients with advanced solid tumors: surgical experience and long-term follow-up," Ann Surg Oncol. Oct. 2005;12(10):825-30.

McWilliams et al., "Mutations in the 5' end of the human immunodeficiency virus type 1 polypurine tract affect RNase H cleavage specificity and virus titer," J Virol. (2003) 77(20):11150-11157.

Meiners PM et al., "Abatacept treatment reduces disease activity in early primary Sjögren's syndrome (open-label proof of concept ASAP study)" Ann Rheum Dis. 2014;73(7):1393-1396.

Merchant et al., "An efficient route to human bispecific IgG," Nat Biotechnol. (1998) 16(7): 677-681.

Mercier et al., "A chimeric adenovirus vector encoding reovirus attachment protein sigma targets cells expressing junctional adhesion molecule 1," Proc Natl Acad Sci U S A. (2004) 101(16): 6188-6193.

Miller et al., "Construction and properties of retrovirus packaging cells based on gibbon ape leukemia virus," J Virol. (1991) 65(5):2220-2224.

Miller et al., "Construction and screening of antigen targeted immune yeast surface display antibody libraries," Curr Protoc Cytom. Jul. 2008;Chapter 4:Unit4.7.

Miller et al., "Gene transfer by retrovirus vectors occurs only in cells that are actively replicating at the time of infection," Mol Cell Biol. (1990) 10(8):4239-4242.

Miller, "Protein-protein recognition and the association of immunoglobulin constant domains," J Mol Biol. Dec. 20, 1990;216(4):965-73.

Milone et al., "Chimeric receptors containing CD137 signal transduction domains mediate enhanced survival of T cells and increased antileukemic efficacy in vivo," Mol Ther. (2009) 17(8):1453-64.

Miyoshi et al. "Development of a self-inactivating lentivirus vector," J Virol. (1998) 72(10):8150-8157.

Mizuhara et al., "T cell activation-associated hepatic injury: mediation by tumor necrosis factors and protection by interleukin 6," J Exp Med. 1994 179(5): 1529-1537.

Mochizuki et al., "Delta-like ligand 4 identifies a previously uncharacterized population of inflammatory dendritic cells that plays important roles in eliciting allogeneic T cell responses in mice," J Immunol. (2013) 190(7): 3772-82.

Mollweide et al., "Only therapeutic ICOS:ICOSL blockade alleviates acute graft versus host disease", Klin Padiatr. (2009) 221(6):344-50.

Molin et al., "Two novel adenovirus vector systems permitting regulated protein expression in gene transfer experiments," J Virol. (1998) 72(10):8358-8361.

Morton et al., "Differential effects of CTLA-4 substitutions on the binding of human CD80 (B7-1) and CD86 (B7-2)," J Immunol. (1996) 156(3):1047-1054.

Narumi et al., "Adenovirus vector-mediated perforin expression driven by a glucocorticoid-inducible promoter inhibits tumor growth in vivo," Am J Respir Cell Mol Biol. (1998) 19(6):936-941.

Nightingale et al., "Transient gene expression by nonintegrating lentiviral vectors," Mol Ther. (2006) 13(6):1121-1132.

Nygren, "Conjugation of horseradish peroxidase to Fab fragments with different homobifunctional and heterobifunctional cross-linking reagents. A comparative study," J Histochem Cytochem. May 1982;30(5):407-12.

Omer AK et al., "Late Acute Graft Versus Host Disease After Allogeneic Hematopoietic Stem Cell Transplantation" Biol Blood Marrow Transplant. May 2016; 22(5): 879-883.

Paczesny, "Biomarkers for posttransplantation outcomes," Blood. (2018) 131(20): 2193-2204.

Paczesny et al., "A biomarker panel for acute graft-versus-host disease," Blood. (2009) 113(2): 273-278.

Paczesny et al., "Elafin is a biomarker of graft-versus-host disease of the skin," Sci Transl Med. (2010) 2(13): 13ra2.

Pain et al., "Preparation of protein A-peroxidase monoconjugate using a heterobifunctional reagent, and its use in enzyme immunoassays," J Immunol Methods. (1981);40(2):219-30.

Patton et al., "Evaluation of the efficiency of human immune system reconstitution in NSG mice and NSG mice containing a human HLA.A2 transgene using hematopoietic stem cells purified from different sources", J Immunol Methods. (2015) 422: 13-21.

Patyar et al., "Bacteria in cancer therapy: a novel experimental strategy," J Biomed Sci. (2010) 17(1):21.

Paulos et al., "The inducible costimulator (ICOS) is critical for the development of human T(H)17 cells", Sci Transl Med. (2010) 2(55): 55ra78.

Peach et al., "Both extracellular immunoglobin-like domains of CD80 contain residues critical for binding T cell surface receptors CTLA-4 and CD28," J Biol Chem. (1995) 270(36):21181-7.

Peach et al., "Complementarity determining region 1 (CDR1)- and CDR3—analogous Yegions in CTLA-4 and CD28 determine the binding to B7-1," J Exp Med (1994) 180(6):2049-2058.

Penix et al., "Two essential regulatory elements in the human interferon gamma promoter confer activation specific expression in T cells," J Exp Med. (1993) 178(5):1483-1496.

Peper et al., "An impedance-based cytotoxicity assay for real-time and label-free assessment of T-cell-mediated killing of adherent cells," J Immunol Methods. Mar. 2014;405:192-8.

Pérez De La Lastra et al., "Epitope mapping of 10 monoclonal antibodies against the pig analogue of human membrane cofactor protein (MCP)," Immunology. (1999) 96(4):663-70.

Petkova et al., "Enhanced half-life of genetically engineered human IgG1 antibodies in a humanized FcRn mouse model: potential application in humorally mediated autoimmune disease," Int Immunol. (2006) 18(12):1759-1769.

Peyrin-Biroulet L. et al., "Defining Disease Severity in Inflammatory Bowel Diseases: Current and Future Directions" Clinical Gastroenterology and Hepatology 2016; 14:348-354.

Pfeifer et al., "Gene therapy: promises and problems," Annu Rev Genomics Hum Genet. (2001);2:177-211.

Philpott et al., "Use of nonintegrating lentiviral vectors for gene therapy," Hum Gene Ther. (2007) 18(6): 483-9.

Powell et al., "Sequence and structural determinants required for priming of plus-strand DNA synthesis by the human immunodeficiency virus type 1 polypurine tract," J Virol. (1996) 70(8):5288-5296.

Qin et al., "Incorporation of a hinge domain improves the expansion of chimeric antigen receptor T cells," J Hematol Oncol. (2017) 10(1):68.

Qureshi et al., "Trans-endocytosis of CD80 and CD86: a molecular basis for the cell-extrinsic function of CTLA-4," Science (2011) 332(6029):600-603.

Rajpal A. et al., "Introduction: Antibody Structure and Function" Therapeutic Fc-Fusion Proteins, First Edition. Edited by Steven M. Chamow, Thomas Ryll, Henry B. Lowman, and Deborah Farson. 2014 by Wiley-VCH Verlag GmbH & Co. KGaA.

Ramadan et al., "From proteomics to discovery of first-in-class ST2 inhibitors active in vivo," JCI Insight. (2018) 3(14): e99208.

Ramos et al., "FMS-related tyrosine kinase 3 ligand (Flt3L)/CD135 axis in rheumatoid arthritis", Arthritis Res Ther. (2013) 15(6):R209.

Ravetch et al., "Fc receptors," Annu Rev Immunol. (1991) 9:457-492.

(56) References Cited

OTHER PUBLICATIONS

Reizis et al., "Plasmacytoid Dendritic Cells: Development, Regulation, and Function," Immunity. (2019) 50(1): 37-50.
Ren et al., "The search for drug-targetable diagnostic, prognostic and predictive biomarkers in chronic graft-versus-host disease," Expert Rev Clin Immunol. (2018) 14(5): 389-404.
Rentero et al., "Screening of Large Molecule Diversities by Phage Display," Chimia (Aarau) (2011) 65(11): 843-845.
Rickel et al., "ICOSL Anti-HER2 V-mAbs: Localizing Engineered ICOSL Costimulatory Agonists to HER2+ tumors through Trastuzumab," Abstract for San Antonio Breast Cancer Symposium, San Antonio, TX (Dec. 5-9, 2017) 1 page Published Nov. 5, 2017.
Rickel et al., "ICOSL Anti-HER2 V-mAbs: Localizing Engineered ICOSL Costimulatory Agonists to HER2+ tumors through Trastuzumab," Presentation for San Antonio Breast Cancer Symposium, San Antonio, TX (Dec. 5-9, 2017) 1 page.
Ridgway et al., "'Knobs-into-holes' engineering of antibody CH3 domains for heavy chain heterodimerization," Protein Eng. Jul. 1996;9(7):617-21.
Rixon et al., "Novel Immunomodulatory Proteins Generated Via Directed Evolution of Variant IgSF Domains" PEGS: The Essential Protein Engineering Summit, Boston, MA, Apr. 30-May 1, 2018, 1 page. Abstract.
Rixon et al., "Novel Immunomodulatory Proteins Generated Via Directed Evolution of Variant IgSF Domains" PEGS: The Essential Protein Engineering Summit, Boston, MA, Apr. 30-May 1, 2018, 1 page. Presentation.
Roopenian D.C. et al., "FcRn: the neonatal Fc receptor comes of age" Nautre Review Immunologu, vol. 7, Sep. 2007 pp. 715-725.
Rosenberg et al., "Use of tumor-infiltrating lymphocytes and interleukin-2 in the immunotherapy of patients with metastatic melanoma. A preliminary report," N Engl J Med. (1988) 319(25):1676-1680.
Rowland et al., "Drug localisation and growth inhibition studies of vindesine-monoclonal anti-CEA conjugates in a human tumour xenograft," Cancer Immunol Immunother. (1986);21(3):183-7.
Sadelain, M. et al., "The basic principles of chimeric antigen receptor design." Cancer Discov., Apr. 2013, vol. 3, No. 4, pp. 388-398.
Schilderg et al., "Coinhibitory Pathways in the B7-CD28 Ligand-Receptor Family," Immunity. (2016) 44(5): 955-72.
Sciascia S. et al., "Recent advances in the management of systemic lupus erythematosus" [version 1; referees approved:2] F1000Research 2018, 7(F1000 Faculty Rev):970 Last updated: Jun. 29, 2018.
Seow et al., "Biological gene delivery vehicles: beyond viral vectors," Mol Ther. (2009) 17(5):767-777.
Shields et al., "High resolution mapping of the binding site on human IgG1 for Fc gamma RI, Fc gamma RII, Fc gamma RIII, and FcRn and design of IgG1 variants with improved binding to the Fc gamma R," J Biol Chem. (2001) 276(9):6591-6604.
Shlomchik et al., "Prevention of graft versus host disease by inactivation of host antigen-presenting cells," Science. (1999) 285(5426): 412-415.
Sommerfelt et al., "Receptor interference groups of 20 retroviruses plating on human cells," Virology. (1990) 176(1): 58-69.
Srivastava et al., "Engineering CAR-T cells: Design Concepts," Trends in Immunology (2015) 36(8):494-502.
Sturmhoefel et al., "Potent Activity of Soluble B7-IgG Fusion Proteins in Therapy of Established Tumors and as Vaccine Adjuvant," Cancer Res. (1999) 59(19): 4964-4972.
Tan LK et al., "Influence of the hinge region on complement activation, C1q binding, and segmental flexibility in chimeric human immunoglobulins" Proc. Natl. Acad. Sci. USA vol. 87, pp. 162-166, Jan. 1990 Immunology.
Tangney et al., "The use of Listeria monocytogenes as a DNA delivery vector for cancer gene therapy," Bioeng Bugs. (2010) 1(4):284-287.
Tareen et al., "Design of a novel integration-deficient lentivector technology that incorporates genetic and posttranslational elements to target human dendritic cells," Mol Ther. (2014) 22(3):575-587.

Tartaglia et al., "Highly attenuated poxvirus vectors," AIDS Res Hum Retroviruses. (1992) 8(8):1445-1447.
Taylor et al., "Targeting of inducible costimulator (ICOS) expressed on alloreactive T cells down-regulates graft-versus-host disease (GVHD) and facilitates engraftment of allogeneic bone marrow (BM)", Blood. (2005) 105(8): 3372-3380.
Teshima et al., "Response: Recipient plasmacytoid dendritic cells and graft-versus-host disease", Blood. (2009) 114(6): 1280.
Tewar M Draft Psoriatic Arthritis Guideline Presented at ACR 2017 Nov. 17, 2017.
Thompson et al., "cis-acting sequences required for inducible interleukin-2 enhancer function bind a novel Ets-related protein, Elf-1," Mol Cell Biol. (1992) 12(3):1043-1053.
Tiegs et al., "A T cell-dependent experimental liver injury in mice inducible by concanavalin A." J Clin Invest. (1992) 90(1): 196-203.
Todd et al., "Transcription of the interleukin 4 gene is regulated by multiple promoter elements," J Exp Med. (1993) 177(6):1663-1674.
Toyabe et al., "Requirement of IL-4 and liver NK1+ T cells for concanavalin A-induced hepatic injury in mice," J Immunol (1997) 159:1537-1542.
Trentin F et al., "Effectiveness, Tolerability, and Safety of Belimumab in Patients with Refractory SLE: a Review of Observational Clinical-Practice-Based Studies" Clinical Reviews in Allergy & Immunology (2018) 54:331-343.
Tsuboi H et al., "Effectiveness of abatacept for patients with Sjogren's syndrome associated with rheumatoid arthritis. An open label, multicenter, one-year, prospective study: ROSE (Rheumatoid Arthritis with Orencia Trial toward Sjogren's syndrome Endocrinopathy) trial" Mod Rheumatol, 2016; 26(6):891-899.
Uniprot H9Z6Y0 ICOS ligand Retrieved from https://www.uniprot.org/uniprot/H9Z6Y0. Retrieve on Jul. 10, 2020.
Uniprot L8Y5K4 ICOS Ligand Retrieved from https://www.uniprot.org/uniprot/L8Y5K4. Retrieved on Jul. 10, 2020.
Uzzaman et al., "Classification of hypersensitivity reactions," Allergy Asthma Proc. (2012) 33: S96-S99.
Van Der Lugt et al., "ST2 as a marker for risk of therapy-resistant graft-versus-host disease and death," N Engl J Med. (2013) 369(6): 529-539.
Van Pijkeren et al., "A novel Listeria monocytogenes-based DNA delivery system for cancer gene therapy," Hum Gene Ther. Apr. 2010;21(4):405-16.
Vitetta et al., "Redesigning nature's poisons to create anti-tumor reagents," Science. Nov. 20, 1987;238(4830):1098-104.
Wang et al., "In vitro characterization of the anti-PD-1 antibody nivolumab, BMS-936558, and in vivo toxicology in non-human primates," Cancer Immunol Res. (2014) 2(9):846-856.
Wang et al., "Molecular modeling and functional mapping of B7-H1 and B7-DC uncouple costimulatory function from PD-1 interaction," J Exp Med. 2003 197(9):1083-91.
Watkins et al., "CD28 blockade controls T cell activation to prevent graft-versus-host disease in primates", J Clin Invest. (2018) 128(9): 3991-4007.
Wikenheiser et al., "ICOS Co-Stimulation: Friend or Foe?," Front Immunol (2016) (7):304, 16 pgs.
Wilson et al., "Formation of infectious hybrid virions with gibbon ape leukemia virus and human T-cell leukemia virus retroviral envelope glycoproteins and the gag and pol proteins of Moloney murine leukemia virus," J Virol. (1989) 63(5):2374-2378.
Wu et al., "CTLA-4-B7 Interaction Is Sufficient to Costimulate T Cell Clonal Expansion," J. Exp. Med. (1997) 185(7):1327-1335.
Wu et al., "IL-24 modulates IFN-gamma expression in patients with tuberculosis," Immunol Lett. (2008) 117(1):57-62.
Yao et al., "B7-h2 is a costimulatory ligand for CD28 in human," Immunity. (2011) 34(5):729-40.
Yu et al., "The role of B7-CD28 co-stimulation in tumor rejection," Int Imm (1998) 10(6):791-797.
Zeiser et al., "Acute Graft-versus-Host Disease—Biologic Process, Prevention, and Therapy", N Engl J Med. Nov. 30, 2017;377(22):2167-2179.
Zhang et al., "An NKp30-Based Chimeric Anitgen Receptor Promotes T Cell Effector Functions and Antitumor Efficacy In Vivo," J Immunol (2012) 189:2290-2299.

(56) References Cited

OTHER PUBLICATIONS

Zhang et al., "Preterminal host dendritic cells in irradiated mice prime CD8+ T cell—mediated acute graft-versus-host disease," J Clin Invest. (2002) 109(10): 1335-1344.

Zhang et al., "ST2 blockade reduces sST2-producing T cells while maintaining protective mST2-expressing T cells during graft-versus-host disease", Sci Transl Med. (2015) 7(308): 308ra160.

Zhang et al., "Introduction to the Data Analysis of the Roche xCELLigence® System with RTCA Package," Bioconductor. May, 3, 2016, bioconductor.org/packages/devel/bioc/vignettes/RTCA/inst/doc/aboutRTCA.pdf, accessed Sep. 9, 2016, 11 pages.

Zhao et al., "Structural Design of Engineered Costimulation Determines Tumor Rejection Kinetics and Persistence of CAR T Cells," Cancer Cell (2015) 28(4):415-428.

Zhao et al., "TIGIT overexpression diminishes the function of CD4 T cells and ameliorates the severity of rheumatoid arthritis in mouse models," Exp Cell Res. Jan. 1, 2016;340(1):132-8.

Zimin et al., "A new rhesus macaque assembly and annotation for next-generation sequencing analyses," Biol Direct. Oct. 14, 2014;9(1):20.

Zufferey et al., "Self-inactivating lentivirus vector for safe and efficient in vivo gene delivery," J Virol. (1998) 72(12):9873-9880.

Levin et al., "Tumor-localizing NKp30/ICOSL vIgD fusion proteins direct effective dual CD28/ICOS T cell costimulation to B7-H6+ tumor cells in vitro and tumors in vivo" Abstract SITC 2018.

Levin et al., "Tumor-Localizing NKp30/ICOSL vIgD Fusion Proteins Direct Effective Dual CD28/ICOS T cell Costimulation to B7-H6+ Tumor Cells in vitro and Tumors in vivo" Poster 2018 SITC (Nov. 7-11, 2018) Published Nov. 6, 2018.

\* cited by examiner

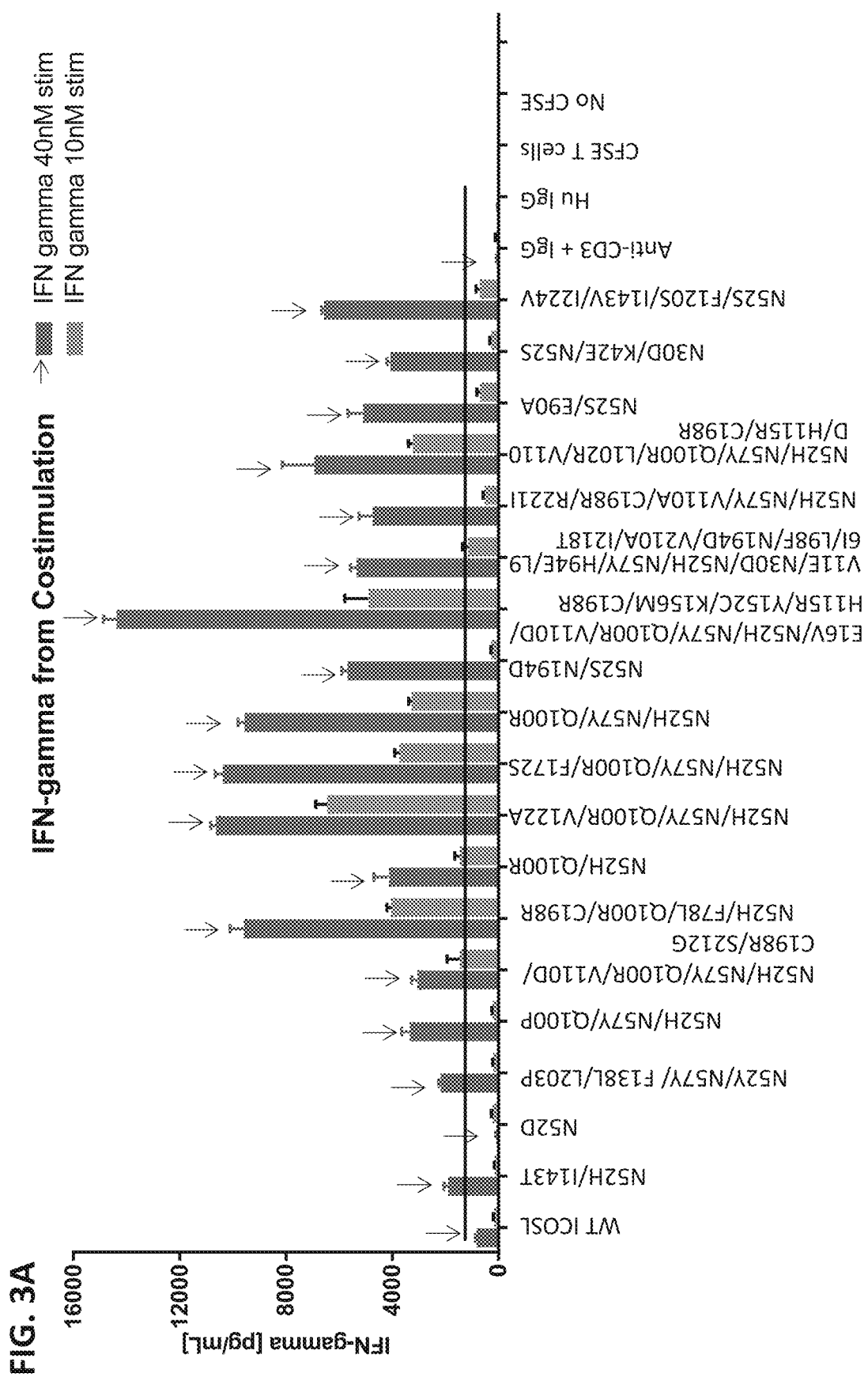

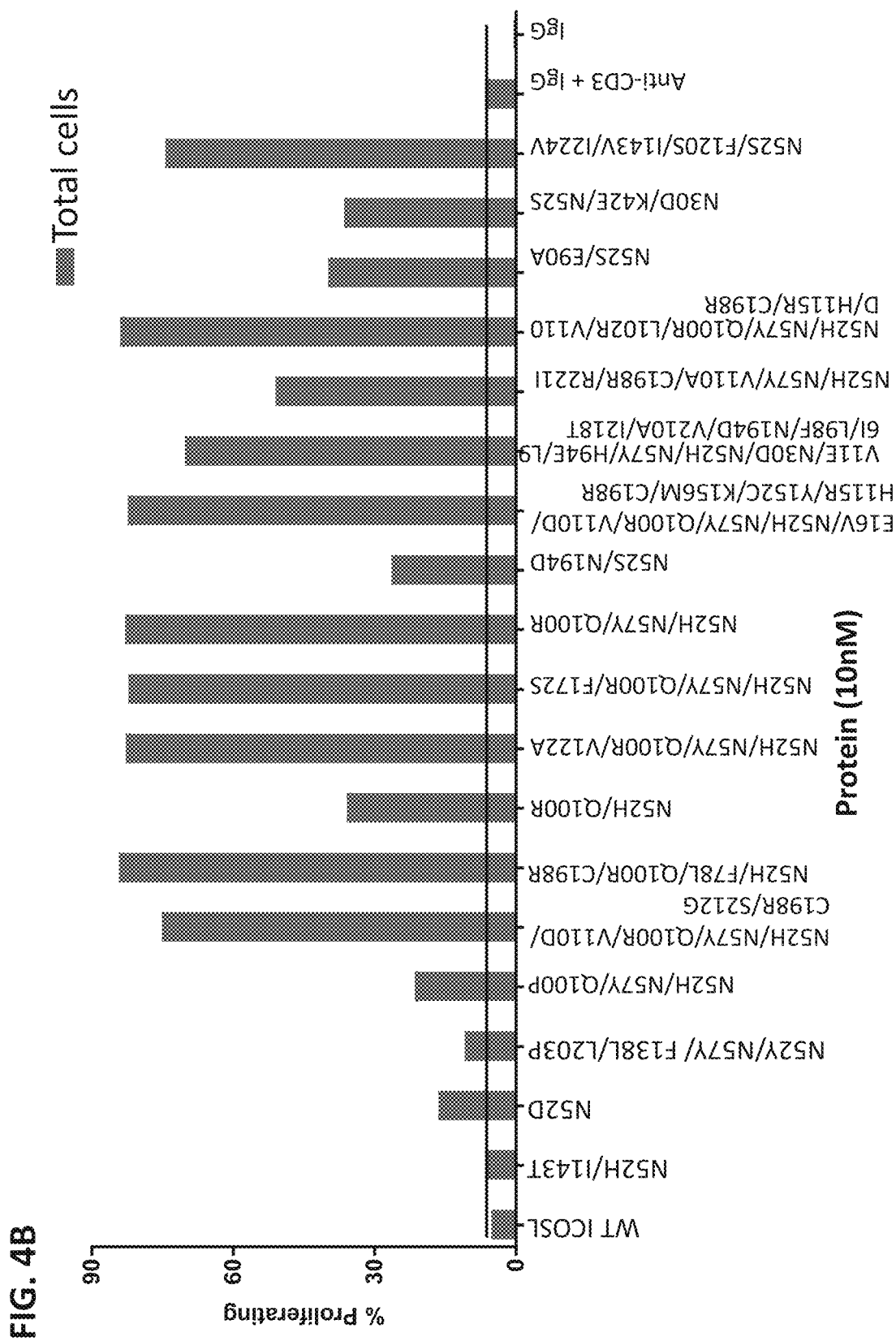

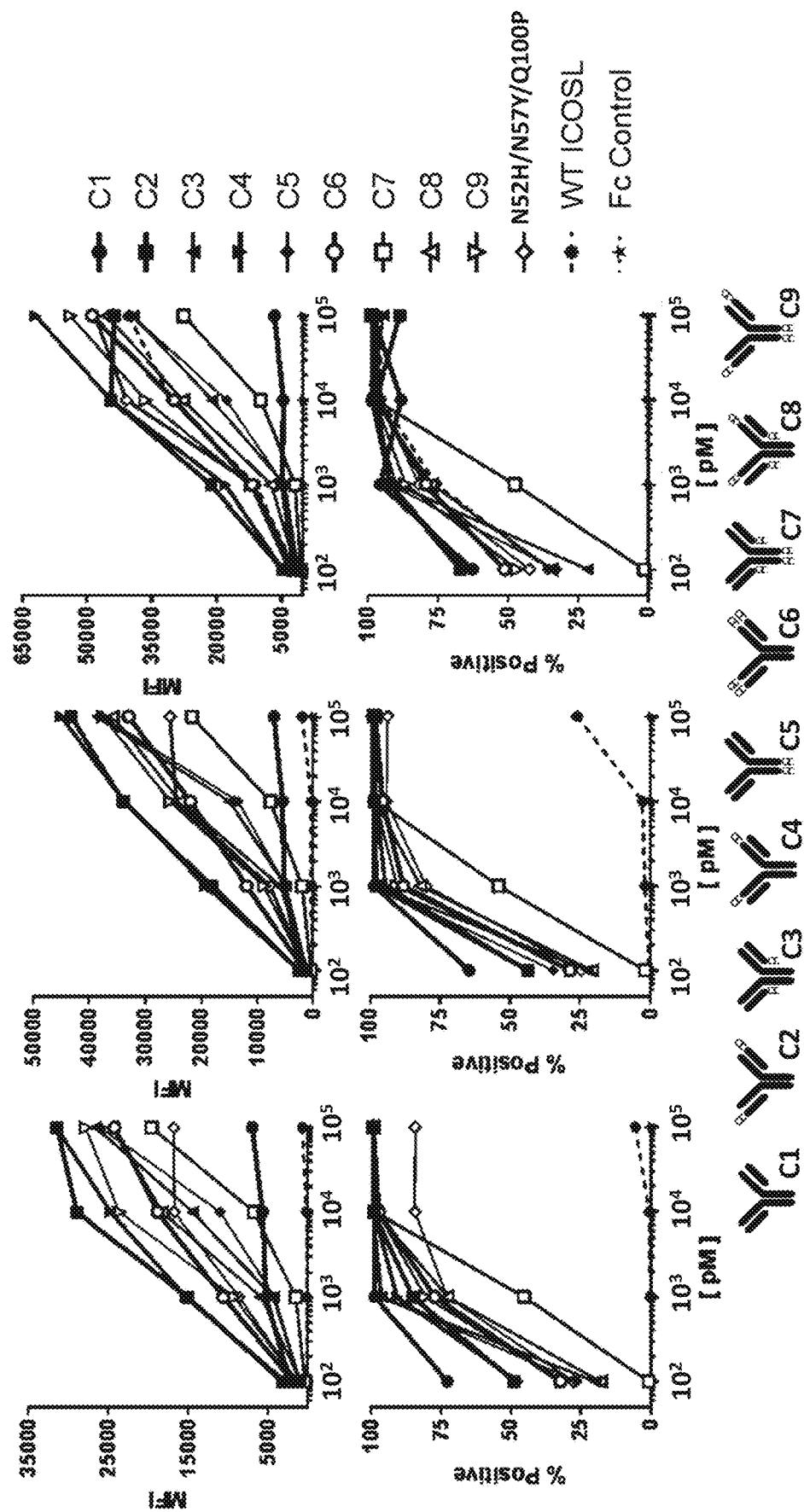

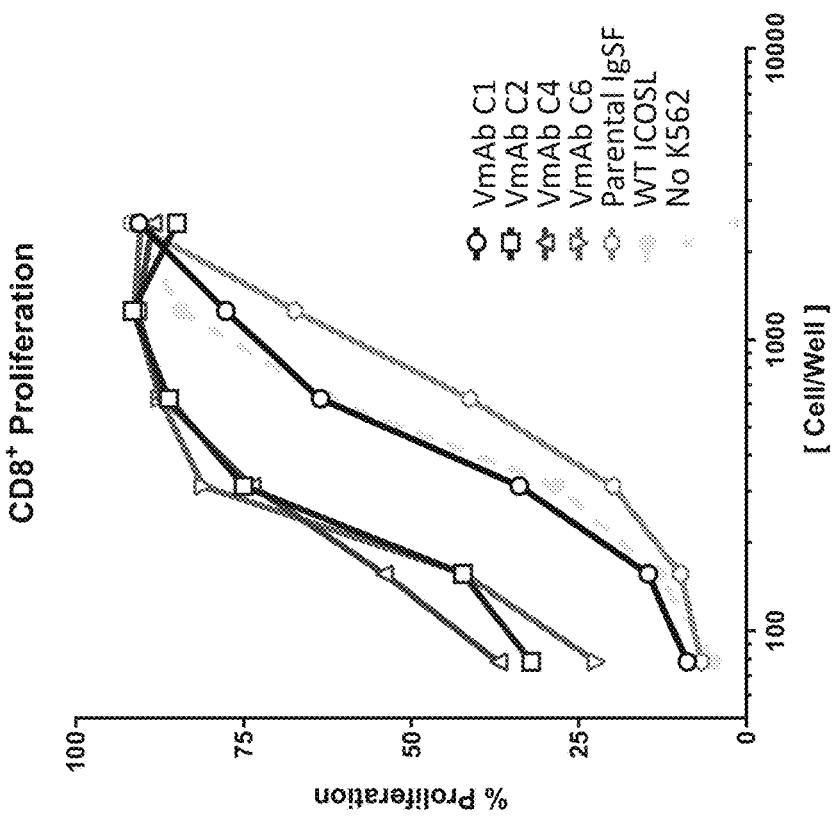
FIG. 20A
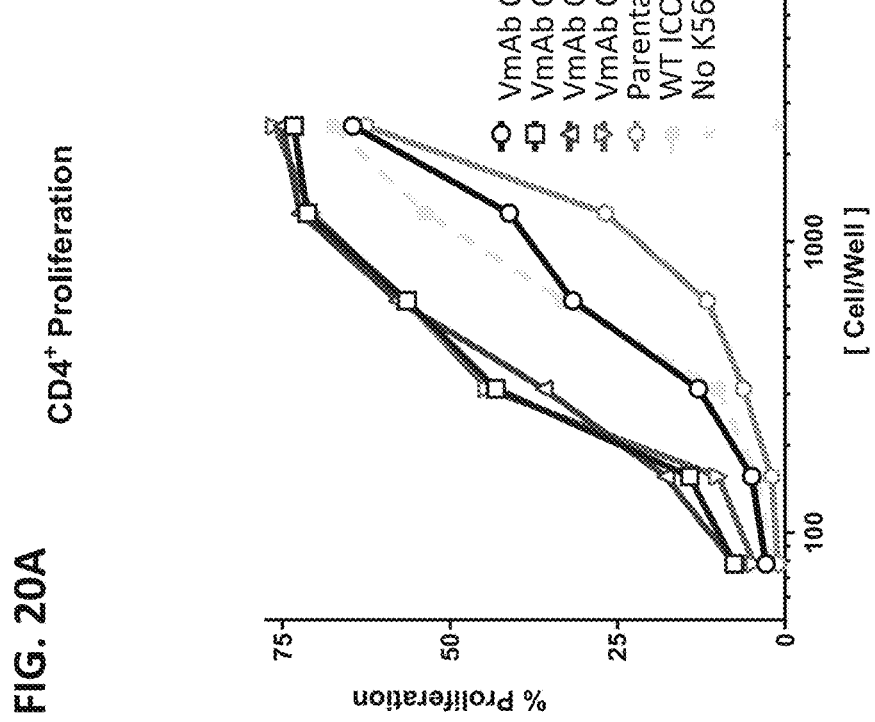

FIG. 22G

ICOSL variant IgV (SEQ ID NO: 545) with N52H/N57Y/Q100R/F172S

Peak1 - 12.165
Peak3 - 15.569
18.559

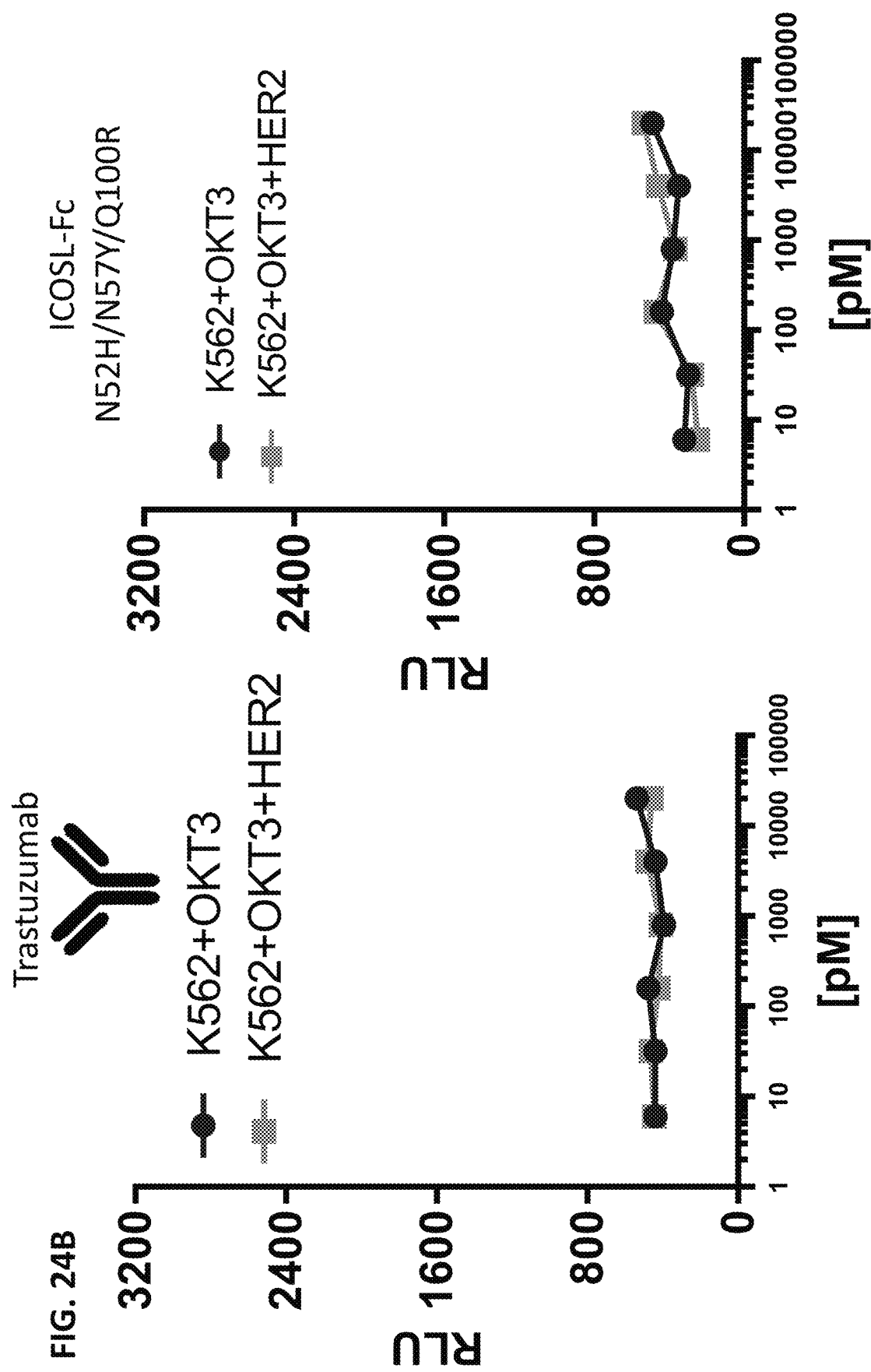

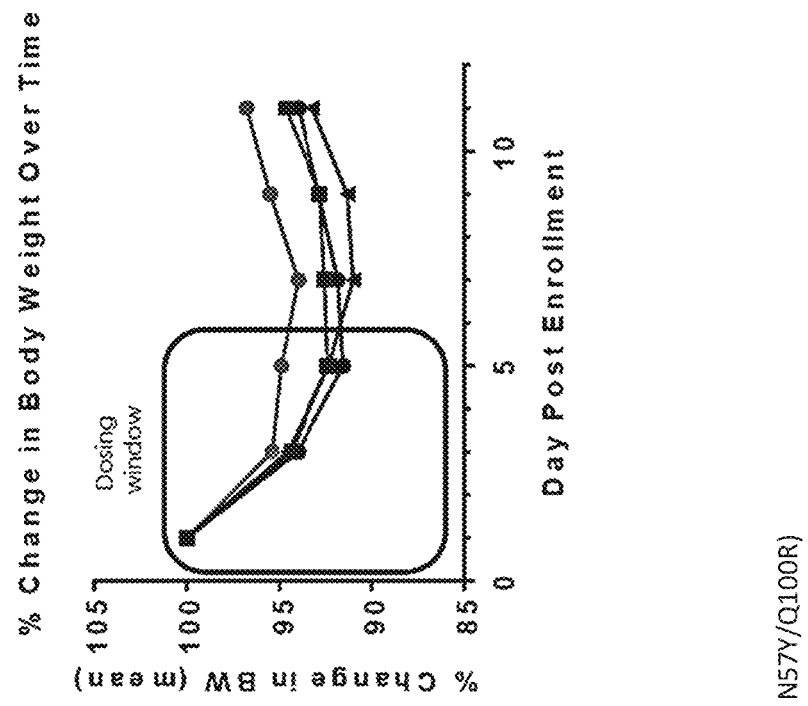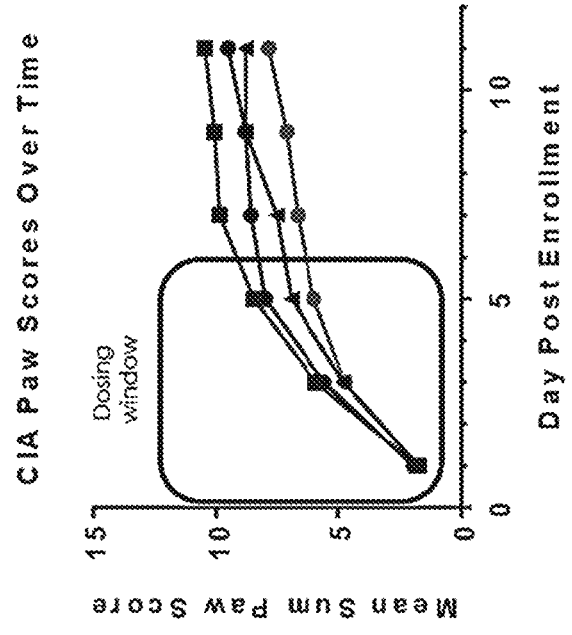

FIG. 33E  %CD28+ of huCD4+ T Cells
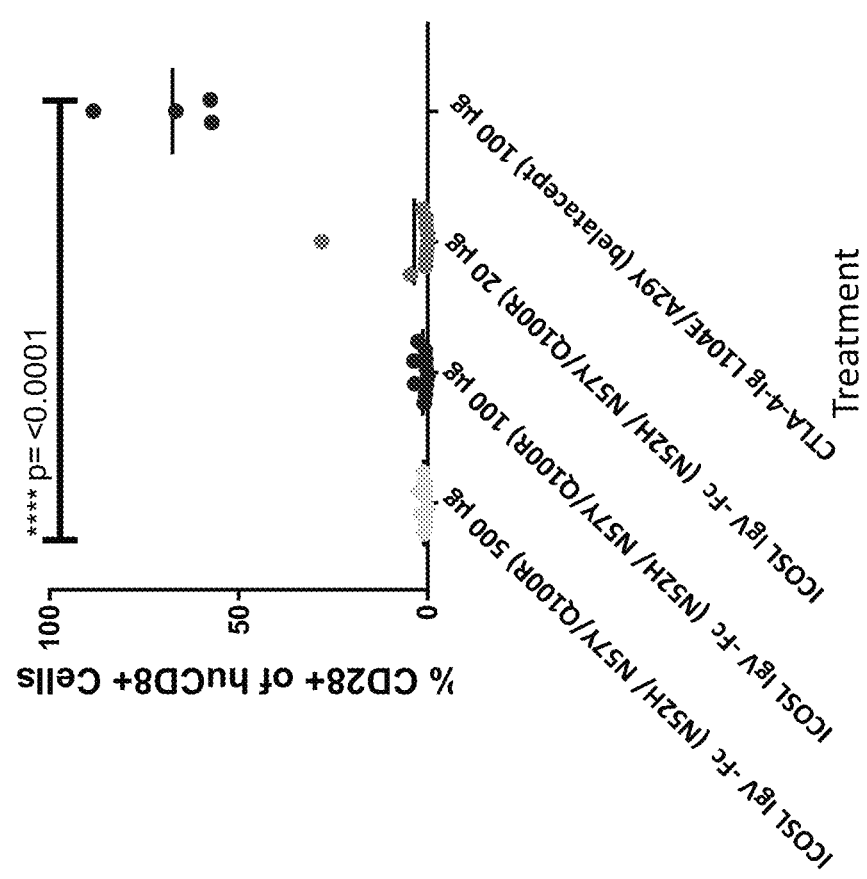
FIG. 33F  %CD28+ of huCD8+ T Cells
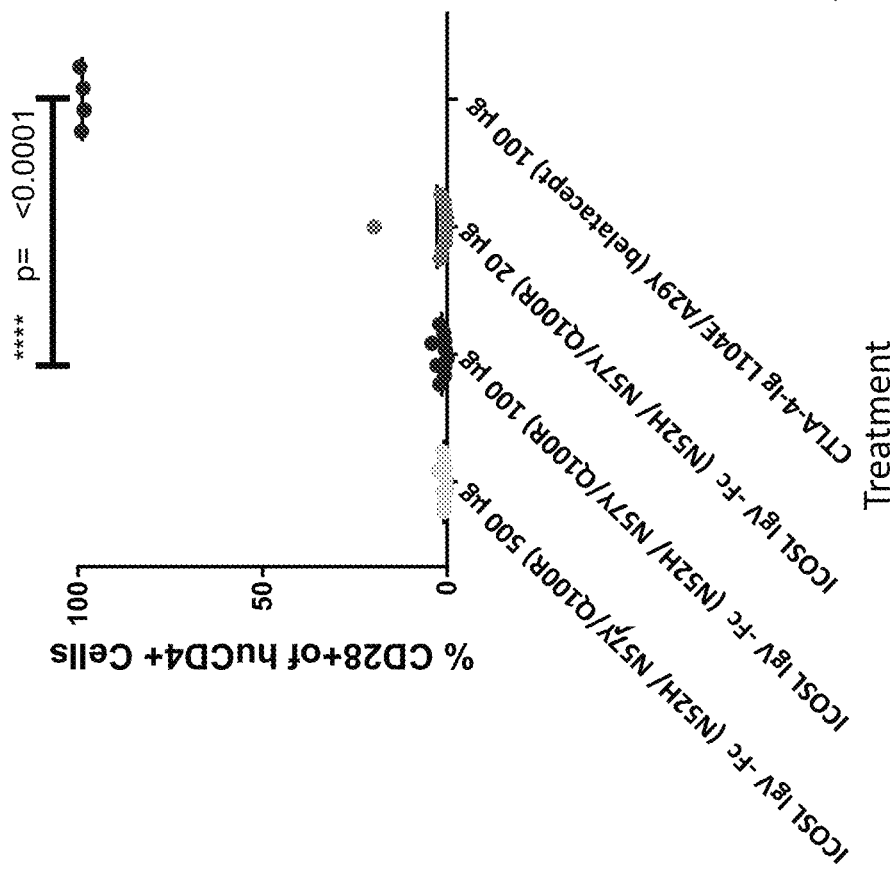

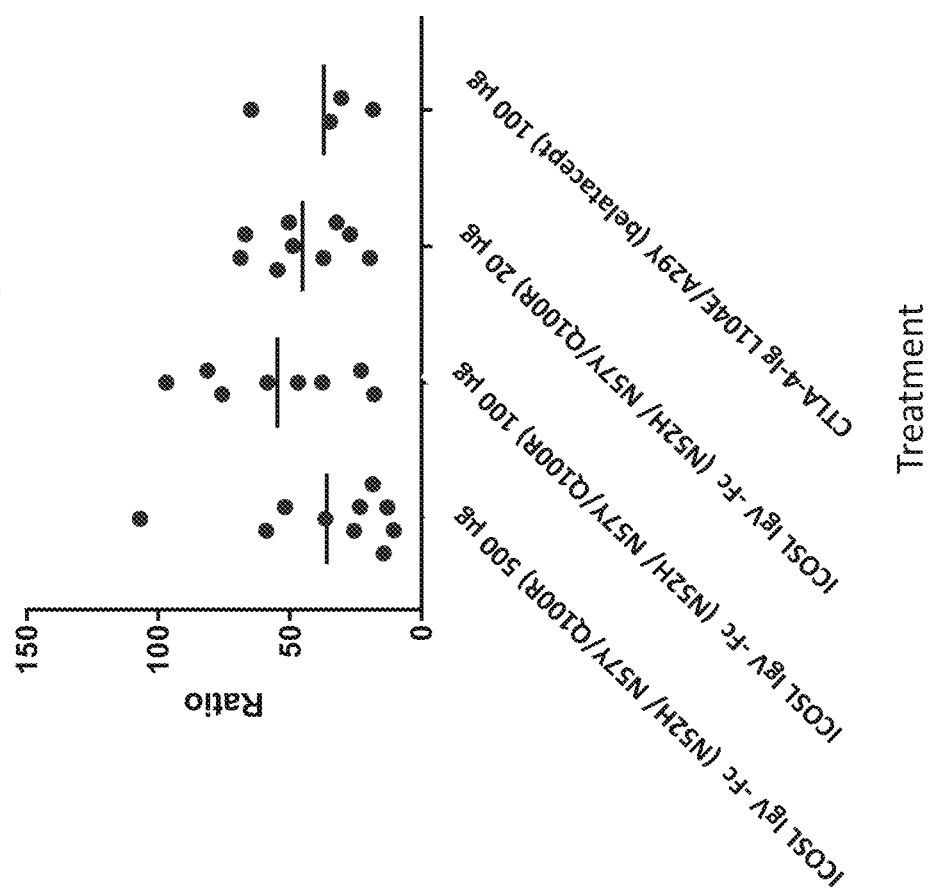

VARIANT ICOS LIGAND IMMUNOMODULATORY PROTEINS AND RELATED COMPOSITIONS AND METHODS

CROSS-REFERENCE TO RELATED APPLICATIONS

This application is a continuation of U.S. application Ser. No. 16/757,344 filed on Apr. 17, 2020, which is a National Stage application under 35 U.S.C. § 371 of International Application No. PCT/US2018/056381, filed on Oct. 17, 2018, which claims priority from U.S. provisional patent application 62/574,161, filed Oct. 18, 2017, entitled "VARIANT ICOS LIGAND IMMUNOMODULATORY PROTEINS AND RELATED COMPOSITIONS AND METHODS," the contents of which are incorporated by reference in their entirety.

INCORPORATION BY REFERENCE OF SEQUENCE LISTING

The present application is being filed along with a Sequence Listing in electronic format. The Sequence Listing is provided as a file entitled 761612002201SeqList.txt, created Dec. 22, 2021, which is 1,656,076 bytes in size. The information in the electronic format of the Sequence Listing is incorporated by reference in its entirety.

FIELD

The present disclosure relates to therapeutic compositions for modulating immune response in the treatment of cancer and immunological diseases. In some aspects, the present disclosure relates to particular variants of ICOS Ligand (ICOSL) that exhibit improved binding, such as improved affinity or selectivity for one or both of the cognate binding partner proteins ICOS or CD28.

BACKGROUND

Modulation of the immune response by intervening in the processes that occur in the immunological synapse (IS) formed by and between antigen-presenting cells (APCs) or target cells and lymphocytes is of increasing medical interest. Mechanistically, cell surface proteins in the IS can involve the coordinated and often simultaneous interaction of multiple protein targets with a single protein to which they bind. IS interactions occur in close association with the junction of two cells, and a single protein in this structure can interact with both a protein on the same cell (cis) as well as a protein on the associated cell (trans), likely at the same time. Although therapeutics are known that can modulate the IS, improved therapeutics are needed. Provided are immunomodulatory proteins, including soluble proteins or transmembrane immunomodulatory proteins capable of being expressed on cells, that meet such needs.

SUMMARY

Provided herein is a variant ICOS Ligand (ICOSL) polypeptide containing one or more amino acid modifications in an immunoglobulin superfamily (IgSF) domain of an ICOSL reference polypeptide, wherein the ICOSL reference polypeptide is a truncated extracellular domain comprising a contiguous sequence of amino acids comprising amino acids 1-112 and a C-terminal truncation of at least 25 amino acids with reference to the ICOSL extracellular domain sequence set forth in SEQ ID NO: 32. In some of any of the provided embodiments, the variant ICOSL polypeptide exhibits altered binding to the ectodomain(s) of ICOS or CD28 compared to the binding of the ICOSL reference polypeptide for the same ectodomain(s). In some of any of the provided embodiments, the variant ICOSL polypeptide exhibits increased binding to the ectodomain(s) of ICOS or CD28 compared to the binding of the ICOSL reference polypeptide for the same ectodomain(s).

In some of any such embodiments, the C-terminal truncation is of at least 30, at least 40, at least 50, at least 60, at least 70, at least 80, at least 90, at least 100, at least 125 amino acid residues. In some of any of the provided embodiments, the ICOSL reference polypeptide is altered in or lacks a protease cleavage site set forth as amino acids 204-209 of SEQ ID NO:32. In some examples, the ICOSL reference polypeptide contains the sequence of amino acids set forth in SEQ ID NO: 545. In some aspects, the ICOSL reference polypeptide consists of the sequence of amino acids set forth in SEQ ID NO: 545.

Provided herein is a variant ICOSL Ligand (ICOSL) polypeptide containing one or more amino acid modifications in an ICOSL reference polypeptide, wherein the ICOSL reference polypeptide consists of the sequence of amino acids set forth in SEQ ID NO: 545. Also provided herein is a variant ICOSL Ligand (ICOSL) polypeptide containing one or more amino acid modifications in an immunoglobulin superfamily (IgSF) domain of an ICOSL reference polypeptide, wherein the ICOSL reference polypeptide is altered in one or more amino acids corresponding to amino acids 204-209 with reference to SEQ ID NO: 32. In some of any of the provided embodiments, the variant ICOSL polypeptide exhibits altered binding to one or more of its binding partner(s) compared to the binding of the ICOSL reference polypeptide for the one or more binding partner(s). In some of any of the provided embodiments, the variant ICOSL polypeptide exhibits increased binding to one or more of its binding partner(s) compared to the binding of the ICOSL reference polypeptide for the one or more binding partner(s).

In some of any of the provided embodiments, the alteration (e.g., modification) includes a deletion of one or more contiguous amino acids corresponding to amino acids 204-209 with reference to SEQ ID NO: 32. In some cases, the ICOSL reference polypeptide comprises the sequence of amino acids set forth in any of SEQ ID NOS: 600-605. In some of any of the provided embodiments, the ICOSL reference polypeptide consists of the sequence of amino acids set forth in any of SEQ ID NOS: 600-605.

In some of any of the provided embodiments, the alteration (e.g., modification) includes at least one amino acid substitution at one or both of position 207 and 208 corresponding to positions set forth in SEQ ID NO: 32. In some examples, the at least one amino acid substitution is N207A, N207G or L208G, or a conservative amino acid substitution thereof.

In some of any of the provided embodiments, the reference ICOSL polypeptide contains the sequence of amino acids set forth in any of SEQ ID NOS: 623-628. In some of any of the provided embodiments, the reference ICOSL polypeptide consists of the sequence of amino acids set forth in any of SEQ ID NOS: 623-628.

In some of any of the provided embodiments, the variant ICOSL polypeptide exhibits reduced proteolytic cleavage when expressed from a cell. In some examples, the cell is a mammalian cell. In some cases, the cell is a Chinese Hamster Ovary (CHO) cell line or a derivative thereof.

In some of any such embodiments, the amino acid modification is an amino acid substitution, insertion or deletion. In some of any of the provided embodiments, the one or more amino acid modifications are in a position corresponding to position(s) selected from 10, 11, 13, 16, 18, 20, 25, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 138, 139, 140, 142, 143, 144, 146, 148, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32. In some of any of the provided embodiments, the one or more amino acid modifications are in a position corresponding to position(s) selected from 10, 11, 13, 16, 18, 20, 25, 26, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 137, 138, 139, 140, 142, 143, 144, 146, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32.

In some of any of the provided embodiments, the one or more amino acid modifications are selected from M10V, M10I, V11E, S13G, E16V, S18R, A20V, S25G, F27S, F27C, N30D, Y33del, Q37R, K42E, T43A, Y47H, N52A, N52C, N52D, N52G, N52H, N52K, N52L, N52M N52Q, N52R, N52S, N52T, N52V, N52Y, S54A, S54P, N57A, N57D, N57E, N57F, N57H, N57K, N57L, N57M, N57P, N57Q, N57S, N57T, N57V, N57Y, N57W, R61S, R61C, Y62F, L67P, A71T, G72R, L74Q, R75Q, D77G, F78L, L80P, N84Q, E90A, K92R, F93L, H94E, H94D, L96F, L96I, V97A, L98F, S99G, Q100A, Q100D, Q100G, Q100K, Q100L, Q100M, Q100N, Q100P, Q100R, Q100S, Q100T, Q100V, L102R, G103E, V107A, V107I, S109G, S109N, V11D, V110N, V110A, E111del, T113E, H115R, H115Q, V116A, A117T, N119Q, F120I, S121G, V122A, V122M, F120S, S126T, S126R, H129P, S130G, S132F, Q133H, E135K, F138L, T139S, C140del, C140D, S142F, I143V, I143T, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193M, N194D, C198R, N201S, L203F, L203P, N207Q, L208P, V210A, S212G, D217V, I218T, I218N, E220G, R221G, R221I, I224V, T225A, N227K, or a conservative amino acid substitution thereof.

In some of any of the provided embodiments, the one or more amino acid modifications are selected from M10V, M10I, V11E, S13G, E16V, S18R, A20T, A20V, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110D, V110I, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193M, N194D, C198R, N201S, L203P, L203F, N207Q, L208P, V210A, S212G, D217G, D217V, I218N, I218T, E220G, R221G, R221I, R221K, I224V, T225A, T225S, N227K, or a conservative amino acid substitution thereof.

In some of any of the provided embodiments, the one or more amino acid modifications are in a position corresponding to position(s) 52, 57 or 100. In some of any of the provided embodiments, the one or more amino acid modifications are selected from N52A, N52C, N52D, N52G, N52H, N52K, N52L, N52M, N52Q, N52R, N52S, N52T, N52V, N52Y, N57A, N57D, N57E, N57F, N57H, N57K, N57L, N57M, N57P, N57Q, N57S, N57T, N57V, N57Y, N57W, Q100A, Q100D, Q100G, Q100K, Q100L, Q100M, Q100N, Q100P, Q100R, Q100S, Q100T or Q100V. In some of any of the provided embodiments, the one or more amino acid modifications are selected from N52A, N52C, N52D, N52G, N52H, N52K, N52L, N52M, N52Q, N52R, N52S, N52T, N52V, N52Y, S54A, S54P, N57A, N57D, N57E, N57F, N57H, N57K, N57L, N57M, N57P, N57Q, N57S, N57T, N57V, N57Y, N57W, Q100A, Q100D, Q100G, Q100K, Q100L, Q100M, Q100N, Q100P, Q100R, Q100S, Q100T or Q100V. In some examples, the one or more amino acid modifications are selected from among N52Y/N57Y/F138L/L203P, N52H/N57Y/Q100P, N52S/Y146C/Y152C, N52H/C198R, N52H/C140D/T225A, N52H/C198R/T225A, N52H/K92R, N52H/S99G, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, N52D/S54P, N52K/L208P, N52S/Y152H, N52D/V151A, N52H/I143T, N52S/L80P, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/R61S/Q100R/V110D/L173S, N52H/N57Y/Q100R/V122A, N52H/N57Y/Q100R/F172S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N30D/N52S/L67P/Q100K/D217G/R221K/T225S, N52H/N57Y/Q100R/V110D/A117T/T190S/C198R, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M/C198R, N52H/N57Y/R61C/Y62F/Q100R/V110N/F120S/C198R, N52H/N57Y/Q100R/V110D/H115R/C198R, N52H/N57Y/Q100R/V110D/N144D/F172S/C198R, N52S/H94E/L98F/Q100R, N52S/E90A, N30D/K42E/N52S, N52S/F120S/I143V/I224V, N52H/N57Y/Q100R/V110D/C198R/S212G, N52H/N57Y/Q100R/C198R, N52S/N194D, N52H/N57Y/Q100R/L102R/

V110D/H115R/C198R, N52H/N57Y/Q100R/V110D/ C198R/S212G, N52H/N57Y/Q100R/C198R, N52S/N194D, N52H/N57Y/Q100R/L102R/V110D/H115R/C198R, N52S/ S54P, T38P/N52S/N57D, N52H/C140del/T225A, N52H/ F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/ N57Y/Q100R/V110D/S132F/M175T, N52D, N52H/N57Y/ Q100R/V107I/V110D/I154F/C198R/R221G, N52Q/ N207Q, N52Q/N168Q, N52Q/N84Q, N52Q/N119Q, N52Q/ N84Q/N168Q, N52Q/N84Q/N207Q, N52Q/N119Q/ N155Q, N52H/N84Q/N119Q, N52H/N84Q, N52H/N84Q/ N168Q/N207Q, N52Q/N84Q/N155Q/N168Q, N52Q/ N84Q/N119Q/N168Q, N52Q/N84Q/N119Q/N207Q, N52Q/N84Q/N119Q/N155Q, N52Q/N84Q/N119Q/N155Q/ N207Q, N52Y/F138L/L203P, N57Y/Q100R/C198R, N57Y/ F138L/L203P, Q100R/F138L, N52H/N57Y/Q100R/H115R/ C198R, N52H/N57Y/Q100R/F172S/C198R, N52H/N57Y/ Q100R/H115R/F172S/C198R, N52H/N57Y/Q100R/ H115R/I143V/F172S/C198R, N52H/N57Y/Q100R/L102R/ H115R/F172S/C198R, N52H/V122A/F172S/C198R, N52H/N57Y/Q100R/H115R/F172S/N194D, N52H/N57Y/ H115R/F172S/C198R, N52H/N57Y/Q100R/H115R/ C198R, N52H/N57Y/H115R, N52H/N57Y/Q100R/H115R, N52H/N57Y/Q100R/H115R/F172S/I224V, N52H/N57Y/ Q100R/H115R/F172S, N52H/N57Y/Q100R/F172S, N52H/ Q100R/H115R/I143T/F172S, N52H/N57Y/Q100P/H115R/ F172S, N52Y/N57Y/Q100P/F172S, E16V/N52H/N57Y/ Q100R/V110D/H115R/C198R, E16V/N52H/N57Y/Q100R/ V110D/H115R/Y152C/K156M/F172S/C198R, N52S/ E90A/H115R, N30D/K42E N52S/H115R, N30D/K42E/ N52S/H115R/C198R/R221I, N30D/K42E/N52S/H115R/ C198R, N30D/K42E/N52S/H115R/F172S/N194D, N52S/ H115R/F120S/I143V/C198R, N52S/H115R/F172S/C198R, N52H/N57Y/Q100P/C198R, N52H/N57Y/Q100P H115R/ F172S/C198R, N52H/N57Y/Q100P/F172S/C198R, N52H/ N57Y/Q100P/H115R, N52H/N57Y/Q100P/H115R/C198R, N52H/Q100R/C198R, N52H/Q100R/H115R/F172S, N52H/ Q100R/F172S/C198R, N52H/Q100R/H115R/F172S/ C198R, N52H/N57Y/Q100R/F172S/C198R, N52A/N57F/ Q100S, N52A/N57H/Q100S, N52A/N57Y/Q100A, N52D/ N57A/Q100A, N52D/Q100S, N52G/Q100A, N52H/ Q100A, N52M/N57H/Q100S, N52M/N57W/Q100P, N52Q/ N57F, N52Q/N57S/Q100A, N52R/N57L/Q100A, N52R/ N57Y/Q100P, N52R/N57Y/Q100S, N52S/N57A/Q100A, N52S/N57H/Q100E, N52S/N57L/Q100S, N52S/N57M/ Q100S, N52S/N57Y/Q100S, N52S/N57Y/Q100M, N52S/ N57Y/Q100V, N52T/N57H/Q100S, N52T/N57H/Q100A, N52T/N57Y/Q100A, N52V/N57L/Q100A, N52H/N57Y/ Q100K, N52K/N57Y/Q100R, N52L/N57H/Q100R, N52R/ N57F/Q100N, N52R/N57F/Q100P, N52R/N57F/Q100R, N52R/N57F/Q100T, N52R/N57H/Q100K, N52R/N57L/ Q100S, N52R/N57W/Q100K, N52R/N57W, N52R/N57Y/ Q100R, N52C/N57E/Q100S, N52G/N57P/Q100D, N52G/ N57V/Q100G, N52G/N57V, N52L/N57V, N52P/N57P, N52P/N57S/Q100G, N52S/N57L/Q100G, N52T/N57K/ Q100P, N52V/N57T/Q100L or N57Q/Q100P.

In some of any of the provided embodiments, the one or more amino acid modifications are selected from among N52Y/N57Y/F138L/L203P, N52H/N57Y/Q100P, N52S/ Y146C/Y152C, N52H/C198R, N52H/C140D/T225A, N52H/C198R/T225A, N52H/K92R, N52H/S99G, N57Y/ Q100P, N52S/S130G/Y152C, N52S/Y152C, N52S/C198R, N52Y/N57Y/Y152C, N52Y/N57Y/H129P/C198R, N52H/ L161P/C198R, N52S/T113E, N52D/S54P, N52K/L208P, N52S/Y152H, N52D/V151A, N52H/I143T, N52S/L80P, F120S/Y152H/N201S, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52S/G103E, N52H/F78L/Q100R, N52H/N57Y/Q100R/ V110D, N52H/N57Y/R75Q/Q100R/V110D, N52H/N57Y/ Q100R, N52H/N57Y/L74Q/Q100R/V110D, N52H/Q100R, N52H/S121G, A20V/N52H/N57Y/Q100R/S109G, N52H/ N57Y/R61S/Q100R/V110D/L173S, N52H/N57Y/Q100R/ V122A, N52H/N57Y/Q100R/F172S, N52H/N57Y, N52S/ F120S, N52S/V97A, N52S/G72R, N52S/A71T/A117T, N52S/E220G, Y47H/N52S/V107A/F120S, N52H/N57Y/ Q100R/V110D/S132F/M175T, E16V/N52H/N57Y/Q100R/ V110D/H115R/Y152C/K156M/C198R, Q37R/N52H/ N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N30D/N52S/L67P/Q100K/D217G/R221K/T225S, N52H/N57Y/Q100R/V110D/A117T/T190S/C198R, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M/C198R, N52H/N57Y/R61C/Y62F/Q100R/V110N/F120S/C198R, N52H/N57Y/Q100R/V110D/H115R/C198R, N52H/N57Y/Q100R/V110D/N144D/F172S/C198R, N52S/H94E/L98F/Q100R, N52S/E90A, N30D/K42E/N52S, N52S/F120S/I143V/I224V, N52H/N57Y/Q100R/V110D/C198R/S212G, N52H/N57Y/Q100R/C198R, N52S/N194D, N52H/N57Y/Q100R/L102R/V110D/H115R/C198R, N52H/N57Y/Q100R/V110D/C198R/S212G, N52H/N57Y/Q100R/C198R, N52S/N194D, N52H/N57Y/Q100R/L102R/V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/N57Y/Q100R/V110D/S132F/M175T, N52H/N57Y/Q100R/V107I/V110D/I154F/C198R/R221G, N52Q/N207Q, N52Q/N168Q, N52Q/N84Q, N52Q/N119Q, N52Q/N84Q/N168Q, N52Q/N84Q/N207Q, N52Q/N119Q/N155Q, N52H/N84Q/N119Q, N52H/N84Q, N52H/N84Q/N168Q/N207Q, N52Q/N84Q/N155Q/N168Q, N52Q/N84Q/N119Q/N168Q, N52Q/N84Q/N119Q/N207Q, N52Q/N84Q/N119Q/N155Q, N52Q/N84Q/N119Q/N155Q/N207Q, N52Y/F138L/L203P, N57Y/Q100R/C198R, N57Y/F138L/L203P, Q100R/F138L, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/V122A/F172S/C198R, N52H/N57Y/Q100R/H115R/F172S/N194D, N52H/N57Y/H115R/F172S/C198R, N52H/N57Y/H115R, N52H/N57Y/Q100R/H115R, N52H/N57Y/Q100R/H115R/F172S/I224V, N52H/N57Y/Q100R/H115R/F172S, N52H/N57Y/Q100R/F172S, N52H/Q100R/H115R/I143T/F172S, N52H/N57Y/Q100P/H115R/F172S, N52Y/N57Y/Q100P/F172S, E16V/N52H/N57Y/Q100R/V110D/H115R/C198R, E16V/N52H/N57Y/Q100R/V110D/H115R/Y152C/K156M/F172S/C198R, N52S/E90A/H115R, N30D/K42E N52S/H115R, N30D/K42E/N52S/H115R/C198R/R221I, N30D/K42E/N52S/H115R/C198R, N30D/K42E/

N52S/H115R/F172S/N194D, N52S/H115R/F120S/I143V/
C198R, N52S/H115R/F172S/C198R, N52H/N57Y/Q100P/
C198R, N52H/N57Y/Q100P/H115R/F172S/C198R, N52H/
N57Y/Q100P/F172S/C198R, N52H/N57Y/Q100P/H115R,
N52H/N57Y/Q100P/H115R/C198R, N52H/Q100R/C198R,
N52H/Q100R/H115R/F172S, N52H/Q100R/F172S/C198R,
N52H/Q100R/H115R/F172S/C198R, N52H/N57Y/Q100R/
F172S/C198R, N52A/N57F/Q100S, N52A/N57H/Q100S,
N52A/N57Y/Q100A, N52D/N57A/Q100A, N52D/Q100S,
N52G/Q100A, N52H/Q100A, N52M/N57H/Q100S, N52M/
N57W/Q100P, N52Q/N57F, N52Q/N57S/Q100A, N52R/
N57L/Q100A, N52R/N57Y/Q100P, N52R/N57Y/Q100S,
N52S/N57A/Q100A, N52S/N57H/Q100E, N52S/N57L/
Q100S, N52S/N57M/Q100S, N52S/N57Y/Q100S, N52S/
N57Y/Q100M, N52S/N57Y/Q100V, N52T/N57H/Q100S,
N52T/N57H/Q100A, N52T/N57Y/Q100A, N52V/N57L/
Q100A, N52H/N57Y/Q100K, N52K/N57Y/Q100R, N52L/
N57H/Q100R, N52R/N57F/Q100N, N52R/N57F/Q100P,
N52R/N57F/Q100R, N52R/N57F/Q100T, N52R/N57H/
Q100K, N52R/N57L/Q100S, N52R/N57W/Q100K, N52R/
N57W, N52R/N57Y/Q100R, N52C/N57E/Q100S, N52G/
N57P/Q100D, N52G/N57V/Q100G, N52G/N57V, N52L/
N57V, N52P/N57P, N52P/N57S/Q100G, N52S/N57L/
Q100G, N52T/N57K/Q100P, N52V/N57T/Q100L, N57Q/
Q100P, or R26S/N52H/N57Y/V110D/T137A/C198R.

In some of any of the provided embodiments, the one or more amino acid modifications are N52H/Q100R. In some of any of the provided embodiments, the variant ICOSL polypeptide has the sequence set forth in SEQ ID NO:567.

In some of any of the provided embodiments, the one or more amino acid modifications are N52H/N57Y/Q100R. In some of any of the provided embodiments, the variant ICOSL polypeptide contains the sequence set forth in SEQ ID NO:565.

In some of any of the provided embodiments, the one or more amino acid modifications are N52L/N57H/Q100R. In some of any of the provided embodiments, the variant ICOSL polypeptide contains the sequence set forth in SEQ ID NO: 761.

In some of any of the provided embodiments, the one or more amino acid modifications is N52D. In some of any of the provided embodiments, the variant ICOSL polypeptide contains the sequence set forth in SEQ ID NO: 548.

In some of any of the provided embodiments, the one or more amino acid modifications is N52H/N57Y/Q100P. In some of any of the provided embodiments, the variant ICOSL polypeptide contains the sequence set forth in SEQ ID NO: 570.

In some of any of the provided embodiments, the one or more amino acid modifications are selected from among F120S/Y152H/N201S, E111del, Y33del, N168Q/N207Q, N84Q/N207Q, N155Q/N207Q, N119Q/N168Q, N119Q/N207Q, N119Q/N155Q, N84Q/N119Q, N84Q/N155Q/N168Q, N84Q/N168Q/N207Q, N84Q/N155H/N207Q, N155Q/N168Q/N207Q, N119Q N155Q/N168Q, N119Q/N168Q/N207Q, N84Q/N119Q/N207Q, N119Q/N155H/N207Q, N84Q/N119Q/N155Q, N84Q/N119Q/N155Q/N168Q, N84Q/N155Q/N168Q/N207Q, N84Q/N119Q/N155Q/N207Q, N84Q/N119Q/N155Q/N168Q/N207Q or F138L/L203P.

In some of any such embodiments, the one or more amino acid modifications are selected from C198R, D158G, E16V, E90A, F120S, F138L, F172S, H115R, H115X, I143T, I143V, I224V, K156M, K42E, K92R, L102R, L203P, L208P, N194D, N30D, N52A, N52D, N52G, N52H, N52K, N52L, N52M, N52Q, N52R, N52S, N52T, N52Y, N57F, N57H, N57K, N57L, N57M, N57P, N57S, N57V, N57W, N57Y, Q100A, Q100D, Q100E, Q100K, Q100M, Q100P, Q100R, Q100S, Q100T, Q133H, R221I, R75Q, S54A, S54P, T113E, T225A, V110D, V122A, Y146C, Y152C, A117T, A20V, A71T, A91G, A91G, AE88D, C140del, C198R, D158G, D77G, D90K, E117G, E135K, E16V, E81A, E88D, E90A, F120I, F120S, F138L, F172S, F27C, F92Y, G72R, H115R, H115X, H129P, H94E, I118V, I127T, I143T, I143V, I154F, I218N, I218T, I224V, K156M, K169E, K36G, K42E, K89R, K92R, K93R, L102R, L161P, L166Q, L173S, L203F, L203P, L208P, L209P, L40M, L70Q, L70R, L74Q, L80P, L96I, L98F, M10I, M10V, N115Q, N119Q, N122S, N144D, N155X, N168Q, N168X, N178S, N194D, N207Q, N207X, N227K, N25S, N30D, N52V, N57A, N57F, N57H, N57L, N57M, N57S, N57V, N57W, N57Y, N63S, N84Q, Q100G, Q100N, Q100V, R221G, S109G, S109N, S114T, S121G, S126R, S126T, S130G, S132F, S13G, S18R, S192G, S212G, S25G, S54A, S54P, S99G, T113E, T120S, T130A, T139S, T190A, T199S, T225A, T41I, V107I, V110A, V110D, V11E, V122A, V122M, V193M, V210A, W153R, Y146C, Y152C, or Y152H.

In some of any of the provided embodiments, the one or more amino acid modifications are selected from among N52S, N52H, N52D, N52H/N57Y/Q100P, N52S/Y146C/Y152C, N52H/C198R, N52H/C198R/T225A, N52H/K92R, N57Y, N52S/C198R, N52S/T113E, S54A, N52D/S54P, N52K/L208P, N52H/I143T, N52S/R75Q/L203P, N52S/D158G, N52D/Q133H, N52H/N57Y/Q100R/V122A, N52H/N57Y/Q100R/F172S, N52H/N57Y/Q100R, N52S/N194D, N52H/N57Y/Q100R/L102R/V110D/H115R/C198R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115X/F172S/C198R, N52H/Q100R/H115R/F172S/C198R, N52H/N57Y/Q100R/H115R/F172S/C198R, N52H/N57Y/Q100R/H115R/F172S, N52H/N57Y/Q100R/H115R/F172S/C198R, Q100R, N52Y/F138L/L203P, N57Y/Q100R/C198R, N57Y/F138L/L203P, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R, H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T F172S, N52H/N57Y/Q100P/H115R/F172S, E16V/N52H/N57Y/Q100R/V110D/H115R/C198R, N52S/E90A/H115R, N30D/K42E/N52S/H115R/C198R/R221I, N30D/K42E/N52S/H115R/C198R, N30D/K42E/N52S/H115R/F172S/N194D, N30D/K42E/N52S/H115R, N52S/E90A/H115R, N30D/K42E/N52S/H115R, N52A/N57H/Q100S, N52A/N57Y/Q100A, N52D/Q100S, N52G/Q100A, N52M/N57H/Q100S, N52M/N57W/Q100P, N52Q/N57S/Q100A, N52R/N57L/Q100A, N52S/N57H/Q100E, N52S/N57L/Q100S, N52S/N57M/Q100S, N52S/N57Y/Q100M, N52T/N57H/Q100S, N52R/N57F/Q100P, N52R/N57F/Q100T, N52R/N57W/Q100K, N52R/N57W, N52G/N57P/Q100D, N52G/N57V/Q100G, N52G/N57V, N52L/N57V, N52S/N57L/Q100G or N52T/N57K/Q100P; or N52S, N52H, N52D, N52Y/N57Y/F138L/L203P, N52H/N57Y/Q100P, N52S/Y146C/Y152C, N52H/

C198R, N52H/C140del/T225A, N52H/C198R/T225A, N52H/K92R, N52H/S99G, N57Y, N57Y/Q100P, N52S/ S130G/Y152C, N52S/Y152C, N52S/C198R, N52Y/N57Y/ Y152C, N52Y/N57Y/H129P/C198R, N52H/L161P/C198R, N52S/T113E, S54A, N52D/S54P, N52K/L208P, N52S/ Y152H, N52H/I143T, N52S/L80P, N52S/D158G, N52D/ Q133H, L70Q/A91G/N144D, L70Q/A91G/E117G/I118V/ T120S/T130A, L70R/A91G/I118V/T120S/T130A/T199S, L70Q/E81A/A91G/I118V/T120S/I127T/T130A, N63S/ L70Q/A91G/S114T/I118V/T120S/T130A, T41I/A91G, E88D/K89R/D90K/A91G/F92Y/K93R/N122S/N178S, E88D/K89R/D90K/A91G/F92Y/K93R, AE88D/K89R/ D90K/A91G/F92Y/K93R, K36G/L40M, N52H/N57Y/ Q100R/V122A, N52H/N57Y/Q100R/F172S, N52H/N57Y/ Q100R, N52S/F120S/N227K, N52S/N194D, N52S/F120S, N52S/G72R, N52S/A71T/A117T/T190A/C198R, N52H/ N57Y/Q100R/V107I/V110D/S132F/I154F/C198R/R221G, E16V/N52H/N57Y/Q100R/V110D/H115R/Y152C/ K156M/C198R, N52H/N57Y/Q100R/V110D/C198R, V11E/N30D/N52H/N57Y/H94E/L96I/L98F/N194D/ V210A/I218T, N52S/H94E/L96I/V122M, N52H/N57Y/ H94E/L96I/F120I/S126T/W153R/I218N, M10V/S18R/ N30D/N52S/S126R/T139S/L203F, S25G/N30D/N52S/ F120S/N227K, N52H/N57Y/Q100R/V110D/F172S/ C198R, S25G/F27C/N52H/N57Y/Q100R/V110D/E135K/ L173S/C198R, N52H/N57Y/V110A/C198R/R221I, M10I/ S13G/N52H/N57Y/D77G/V110A/H129P/I143V/F172S/ V193M, C198R, N52H/N57Y/Q100R/L102R/V110D/ H115R/C198R, N52H/N57Y/Q100R/V110D/N144D/ F172S/C198R, N52S/H94E/L98F/Q100R, N52S/E90A, N52S/F120S/I143V/I224V, N52H/N57Y/Q100R/F172S/ C198R, N52H/N57Y/Q100R/H115R/F172S/C198R, N52Y/ N57Y/Q100P/F172S, E16V/N52H/N57Y/Q100R/V110D/ H115R/Y152C/K156M/F172S/C198R, N52S/H115R/ F120S/I143V/C198R, N52H/N57Y/Q100P/C198R, N52H/ N57Y/Q100P/H115R/F172S/C198R, N52H/N57Y/Q100P/ F172S/C198R, N52H/N57Y/Q100P/H115R, N52H/N57Y/ Q100P/H115R/C198R, N52H/Q100R/C198R, N52H/ Q100R/H115R/F172S, N52H/Q100R/H115X/F172S/ C198R, N52H/Q100R/H115R/F172S/C198R, N52H/N57Y/ Q100R/F172S/C198R, N52H/N57Y/Q100R/H115R/F172S/C198R, N52H/N57Y/Q100R/H115R/F172S, N52H/N57Y/Q100R/H115R/F172S/C198R, N52S/H94E/L96I/S109N/L166Q/N52H/N57Y/Q100R/C198R, N52H/N57Y/L74Q/V110D/S192G, N52H/Q100R, N52H/S121G/C198R, A20V/N52H/N57Y/Q100R/S109G, N52H/N57Y/Q100P/C198R, N52H/N57Y/Q100R/V110D/C198R/S212G, L70Q/A91G/I118A/T120S/T130A/K169E, Q100R, N52Y/F138L/L203P, N57Y/Q100R/C198R, N57Y/F138L/L203P, N52H, N57Y, N57Y/Q100P, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T F172S, N52H/N57Y/Q100P/H115R/F172S, E16V/N52H/N57Y/Q100R/V110D/H115R/C198R, N30D/K42E/N52S/H115R/C198R R221I, N52S/E90A/H115R, N30D/K42E/N52S/H115R, N52S/H115R/F172S/C198R, N119Q, N207Q, N52Q/N207X, N168X/N207X, N52Q/N168Q, N84Q/N207Q, N119Q N155X, N52Q/N119Q, N52Q/N84Q/N207Q, N119Q/N155Q/N168Q, N52H/N84Q/N119Q, N52Q/N84Q/N155X/N168X, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57L/Q100S, N52R/N57W/Q100K, N52R/N57W, N52G/N57V, N52L/N57V, N52S/N57L/Q100G, or N52T/N57K/Q100P. In some of any of the provided embodiments, the variant ICOSL polypeptide exhibits increased binding to the ectodomain of ICOS or CD28 compared to the binding of the reference ICOSL polypeptide to the same ectodomain.

In some of any of the provided embodiments, the one or more amino acid modifications are selected from C198R, D158G, E16V, E90A, F120S, F138L, F172S, H115R, I143V, I224V, K156M, K42E, K92R, L102R, L203P, L208P, N194D, N30D, N52A, N52D, N52G, N52H, N52K, N52L, N52M, N52Q, N52R, N52S, N52T, N52Y, N57F, N57H, N57L, N57M, N57S, N57V, N57W, N57Y, Q100A, Q100E, Q100G, Q100K, Q100M, Q100P, Q100R, Q100S, Q133H, S212G, S54A, S54P, T113E, V110D, V122A, Y146C, Y152C, or T225A.

In some examples, the one or more amino acid modifications are selected from among N52A/N57Y/Q100A, N52D/Q100S, N52G/Q100A, N52M/N57H/Q100S, N52M/N57W/Q100P, N52Q/N57S/Q100A, N52R/N57L/Q100A, N52S/N57H/Q100E, N52S/N57L/Q100S, N52S/N57M/Q100S, N52S/N57Y/Q100M, N52T/N57H/Q100S, N52R/N57F/Q100P, N52R/N57F/Q100T, N52R/N57W/Q100K, N52R/N57W, N52G/N57V, N52L/N57V, N52S/N57L/Q100G, N52T/N57K/Q100P, N52S, N52H, N52D, N52Y/N57Y/F138L/L203P, N52H/N57Y/Q100P, N52S/Y146C/Y152C, N52H/C198R, N52H/C198R/T225A, N52H/K92R, N57Y, N52S/C198R, N52S/T113E, S54A, N52D/S54P, N52K/L208P, N52H/I143T, N52S/D158G, N52D/Q133H, N52H/N57Y/Q100R/V110D/C198R/S212G, N52H/N57Y/Q100R/V122A, N52H/N57Y/Q100R/F172S, N52H/N57Y/Q100R, N52S/N194D, N52H/N57Y/Q100R/L102R/V110D/H115R/C198R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/H115X/F172S/C198R, N52H/Q100R/H115R/F172S/C198R, N52H/N57Y/Q100R/H115R/F172S/C198R, N52H/N57Y/Q100R/H115R/F172S, N52H/N57Y/Q100R/H115R/F172S/C198R, Q100R, N52Y/F138L/L203P, N57Y/Q100R/C198R, N57Y/F138L/L203P, N52H, N57Y, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T/F172S, N52H/

N57Y/Q100P/H115R/F172S, E16V/N52H/N57Y/Q100R/ V110D/H115R/C198R, N52S/E90A/H115R, N52S/E90A/ H115R, or N30D/K42E/N52S/H115R. In some of any of the provided embodiments, the variant ICOSL polypeptide exhibits increased binding to the ectodomain of ICOS and CD28 compared to the binding of the reference ICOSL polypeptide to the same ectodomains.

In some of any of the provided embodiments, the variant ICOSL polypeptide contains the sequence of amino acids set forth in any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910, or a sequence of amino acids that exhibits at least 90%, 91%%, 92%, 93%, 94%, 95%, 96%, 97%, 98%, or 99% sequence identity to any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910. In some of any of the provided embodiments, the variant ICOSL polypeptide consists of the sequence of amino acids set forth in any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910, or a sequence of amino acids that exhibits at least 90%, 91%%, 92%, 93%, 94%, 95%, 96%, 97%, 98%, or 99% sequence identity to any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910.

In some of any of the provided embodiments of the variant ICOS Ligand (ICOSL) polypeptide containing an IgV domain or specific binding fragment thereof, an IgC domain or a specific binding fragment thereof, or both, the variant ICOSL polypeptide contains one or more amino acid modifications in an ICOSL reference polypeptide or a specific binding fragment thereof corresponding to amino acid modifications are selected from N52A, N52C, N52D, N52G, N52K, N52L, N52M, N52R, N52T, N52V, N57A, N57E, N57F, N57H, N57K, N57L, N57M, N57P, N57Q, N57S, N57T, N57V, N57W, Q100A, Q100D, Q100G, Q100L, Q100M, Q100N, Q100R, Q100S, Q100T or Q100V with reference to SEQ ID NO:32. In some of any of the provided embodiments, the one or more amino acid modifications are selected from among N52A/N57F/Q100S, N52A/N57H/ Q100S, N52A/N57Y/Q100A, N52D/N57A/Q100A, N52D/ Q100S, N52G/Q100A, N52H/Q100A, N52M/N57H/ Q100S, N52M/N57W/Q100P, N52Q/N57F, N52Q/N57S/ Q100A, N52R/N57L/Q100A, N52R/N57Y/Q100P, N52R/ N57Y/Q100S, N52S/N57A/Q100A, N52S/N57H/Q100E, N52S/N57L/Q100S, N52S/N57M/Q100S, N52S/N57Y/ Q100S, N52S/N57Y/Q100M, N52S/N57Y/Q100V, N52T/ N57H/Q100S, N52T/N57H/Q100A, N52T/N57Y/Q100A, N52V/N57L/Q100A, N52H/N57Y/Q100K, N52K/N57Y/ Q100R, N52L/N57H/Q100R, N52R/N57F/Q100N, N52R/ N57F/Q100P, N52R/N57F/Q100R, N52R/N57F/Q100T, N52R/N57H/Q100K, N52R/N57L/Q100S, N52R/N57W/ Q100K, N52R/N57W, N52R/N57Y/Q100R, N52C/N57E/ Q100S, N52G/N57P/Q100D, N52G/N57V/Q100G, N52G/ N57V, N52L/N57V, N52P/N57P, N52P/N57S/Q100G, N52S/N57L/Q100G, N52T/N57K/Q100P, N52V/N57T/ Q100L or N57Q/Q100P.

In some of any of the provided embodiments, the ICOSL reference polypeptide is a mammalian ICOSL or a specific binding fragment thereof. In some examples, the ICOSL reference polypeptide is a human ICOSL or a specific binding fragment thereof.

In some of any of the provided embodiments, the ICOSL reference polypeptide contains (i) the sequence of amino acids set forth in SEQ ID NO:32, (ii) a sequence of amino acids that has at least 95% sequence identity to SEQ ID NO:32; or (iii) a portion of (i) or (ii) comprising an IgV domain or IgC domain or specific binding fragments thereof or both. In some of any of the provided embodiments, the specific binding fragment of the IgV domain or IgC domain has a length of at least 50, 60, 70, 80, 90, 100, 110 or more amino acids; or the specific binding fragment of the IgV domain contains a length that is at least 80% of the length of the IgV domain set for as amino acids 19-129 of SEQ ID NO:5 and/or the specific binding fragment of the IgC domain comprises a length that is at least 80% of the length of the IgC domain set forth as amino acids 141-227 of SEQ ID NO:5. In some of any of the provided embodiments, the variant ICOSL polypeptide comprises the IgV domain or a specific fragment thereof and the IgC domain or a specific fragment thereof.

In some of any of the provided embodiments, the variant ICOSL polypeptide contains the sequence of amino acids set forth in any one of SEQ ID NOS: 638-685, or a sequence of amino acids that exhibits at least 90%, 91%%, 92%, 93%, 94%, 95%, 96%, 97%, 98%, or 99% sequence identity to any one of SEQ ID NOS: 638-685. In some of any of the provided embodiments, the variant ICOSL polypeptide consists of the sequence of amino acids set forth in any one of SEQ ID NOS: 638-685, or a sequence of amino acids that exhibits at least 90%, 91%%, 92%, 93%, 94%, 95%, 96%, 97%, 98%, or 99% sequence identity to any one of SEQ ID NOS: 638-685.

In some of any of the provided embodiments, the variant ICOSL polypeptide contains the IgV domain or a specific binding fragment thereof. In some of any of the provided embodiments, the variant ICOSL polypeptide contains the sequence of amino acids set forth in any one of SEQ ID NOS: 686-781, or a sequence of amino acids that exhibits at least 90%, 91%%, 92%, 93%, 94%, 95%, 96%, 97%, 98%, or 99% sequence identity to any one of SEQ ID NOS: 686-781. In some of any of the provided embodiments, the variant ICOSL polypeptide consists of the sequence of amino acids set forth in any one of SEQ ID NOS: 686-781, or a sequence of amino acids that exhibits at least 90%, 91%%, 92%, 93%, 94%, 95%, 96%, 97%, 98%, or 99% sequence identity to any one of SEQ ID NOS: 686-781.

In some of any of the provided embodiments, the IgV domain or specific binding fragment thereof is the only ICOSL portion of the variant ICOSL polypeptide. In some examples, the IgC domain or specific binding fragment thereof is the only ICOSL portion of the variant ICOSL polypeptide.

In some of any of the provided embodiments, the variant ICOSL polypeptide exhibits altered binding to the ectodomain of ICOS or CD28 compared to the binding of the ICOSL reference polypeptide for the same ectodomain. In some aspects, the variant ICOSL polypeptide exhibits increased binding to the ectodomain(s) of ICOS or CD28 compared to the binding of the ICOSL reference polypeptide for the same ectodomain(s). In some examples, the binding is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

In some of any such embodiments, the ICOS is a human ICOS. In some of any of the provided embodiments, the CD28 is a human CD28.

In some of any of the provided embodiments, the variant ICOSL polypeptide exhibits decreased binding to the ectodomain of CTLA-4 compared to the binding of the reference ICOSL polypeptide for the same ectodomain. In some examples, the binding is decreased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold. In some of any of the provided embodiments, the CTLA-4 is a human CTLA-4.

In some of any of the provided embodiments, the altered (increased or decreased) binding is altered (increased or decreased) binding affinity. In some of any such embodiments, the variant ICOSL polypeptide comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions. In some cases, the variant ICOSL polypeptide exhibits at least or at least about 90%, 91%, 92%, 93%, 94%, 95%, 96%, 97%, 98% or 99% sequence identity to the ICOSL reference polypeptide.

In some of any of the provided embodiments, the variant ICOSL polypeptide is a soluble protein. In some of any of the provided embodiments, the variant ICOSL polypeptide lacks a transmembrane domain and intracellular signaling domain; and/or when expressed from a cell, the variant ICOSL polypeptide is not expressed on the surface of the cell.

In some of any of the provided embodiments, the variant ICOSL polypeptide further contains transmembrane domain. In some cases, the transmembrane domain contains the sequence of amino acids set forth as residues 257-277 of SEQ ID NO:5 or a functional variant thereof that exhibits at least 85% sequence identity to residues 257-277 of SEQ ID NO:5. In some of any of the provided embodiments, the variant ICOSL polypeptide further contains a cytoplasmic signaling domain linked to the transmembrane domain. In some cases, the cytoplasmic signaling domain contains the sequence of amino acids set forth as residues 278-302 of SEQ ID NO:5 or a functional variant thereof that exhibits at least 85% sequence identity to residues 278-302 of SEQ ID NO:5.

In some of any of the provided embodiments, the variant ICOSL polypeptide is deglycosylated or partially deglycosylated compared to the ICOSL reference sequence.

Provided herein is an immunomodulatory protein containing any of the provided variant ICOSL polypeptide and a half-life extending moiety. In some of any of the provided embodiments, the half-life extending moiety comprises a multimerization domain, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof. In some cases, the half-life extending moiety is or comprises Pro/Ala/Ser (PAS) and the variant ICOSL polypeptide is PASylated. In some of any of the provided embodiments, the half-life extending moiety contains the sequence set forth in SEQ ID NO:904.

In some of any of the provided embodiments, the half-life extending moiety is or contains a multimerization domain. In some instances, the multimerization domain is selected from an Fc region of an immunoglobulin, a leucine zipper, an isoleucine zipper or a zinc finger. In some of any of the provided embodiments, the variant ICOSL polypeptide is linked, directly or indirectly via a linker, to the multimerization domain.

In some of any of the provided embodiments, the immunomodulatory protein is a multimer containing a first variant ICOSL polypeptide linked to a first multimerization domain and a second variant ICOSL polypeptide linked to a second multimerization domain, wherein the first and second multimerization domains interact to form a multimer comprising the first and second variant ICOSL polypeptide. In some cases, the multimer is a dimer.

In some of any of the provided embodiments, the first variant ICOSL polypeptide and the second variant ICOSL polypeptide are the same. In some of any of the provided embodiments, the dimer is a homodimer. In some instances, the dimer is a heterodimer.

In some of any of the provided embodiments, the multimerization domain is or contains an Fc region of an immunoglobulin. In some of any of the provided embodiments, the Fc region is of an immunoglobulin G1 (IgG1) or an immunoglobulin G2 (IgG2) protein. In some examples, the immunoglobulin protein is human and/or the Fc region is human. In some of any of the provided embodiments, the Fc region contains the sequence of amino acids set forth in SEQ ID NO: 227 or a variant thereof that exhibits at least 90%, 91%, 92%, 93%, 94%, 95%, 96%, 97%, 98% or 99% sequence identity to SEQ ID NO:227. In some aspects, the Fc region contains the sequence of amino acids set forth in SEQ ID NO: 226 or a variant thereof that exhibits at least 90%, 91%, 92%, 93%, 94%, 95%, 96%, 97%, 98% or 99% sequence identity to SEQ ID NO:226. In some of any of the provided embodiments, the Fc region exhibits one or more effector functions. In some of any of the provided embodiments, the Fc region exhibits one or more reduced effector function compared to a wildtype Fc region, optionally wherein the wildtype human Fc is of human IgG1.

In some of any of the provided embodiments, the one or more effector function is selected from among antibody dependent cellular cytotoxicity (ADCC), complement dependent cytotoxicity, programmed cell death and cellular phagocytosis. In some of any of the provided embodiments, the Fc region is a variant Fc region comprising one or more amino acid substitutions compared to the wildtype Fc region.

In some of any of the provided examples, the one or more amino acid substitutions of the variant Fc region are selected from N297G, E233P/L234V/L235A/G236del/S267K or L234A/L235E/G237A, wherein the residue is numbered according to the EU index of Kabat. In some of any of the provided embodiments, the variant Fc region further contains the amino acid substitution C220S, wherein the residues are numbered according to the EU index of Kabat. In some aspects, the Fc region contains the sequence of amino acid sequence set forth in any of SEQ ID NOS: 476-478 or a sequence of amino acids that exhibits at least 90%, 91%, 92%, 93%, 94%, 95%, 96%, 97%, 98%, 99% or more sequence identity to any of SEQ ID NOS:476-478 and contains the amino acid substitutions. In some of any of the provided embodiments, the Fc region contains K447del, wherein the residue is numbered according to the EU index of Kabat.

In some of any of the provided embodiments, the Fc region contains the sequence of amino acid sequence set forth in any of SEQ ID NOS: 632-634 or a sequence of amino acids that exhibits at least 90%, 91%, 92%, 93%, 94%, 95%, 96%, 97%, 98%, 99% or more sequence identity to any of SEQ ID NOS: 632-634 and contains the amino acid substitutions.

In some of any of the provided embodiments, the Fc region contains the sequence of amino acid sequence set forth in SEQ ID NOS: 474 or 637, or a sequence of amino acids that exhibits at least 90%, 91%, 92%, 93%, 94%, 95%, 96%, 97%, 98%, 99% or more sequence identity to SEQ ID NOS: 474 or 637 and contains the amino acid substitutions. In some of any of the provided embodiments, the Fc region contains the sequence of amino acids set forth in SEQ ID NO: 478 or SEQ ID NO: 634. In some of any of the provided embodiments, the Fc region contains the sequence of amino acids set forth in SEQ ID NO: 477. In some of any of the provided embodiments, the Fc region contains the sequence of amino acids set forth in SEQ ID NO: 633. In some of any of the provided embodiments, the Fc region contains the sequence of amino acids set forth in SEQ ID NO: 474. In some of any of the provided embodiments, the Fc region contains the sequence of amino acids set forth in SEQ ID NO:637.

Provided herein is an immunomodulatory protein containing (a) a variant ICOSL polypeptide containing one or more amino acid modifications in an immunoglobulin superfamily (IgSF) domain of an ICOSL reference polypeptide, wherein the variant ICOSL polypeptide exhibits altered binding to the ectodomain(s) of ICOS or CD28 compared to the binding of the ICOSL reference polypeptide for the same ectodomain(s); and (b) a variant Fc region containing amino acid substitutions selected from N297G/K447del, E233P/L234V/L235A/G236del/S267K/K447del or L234A/L235E/G237A/K447del compared to wildtype human IgG1, wherein the residues are numbered according to the EU index of Kabat. In some cases, the immunomodulatory protein is a dimer. In some of any of the provided embodiments, the variant Fc region further contains the amino acid substitution C220S, wherein the residues are numbered according to the EU index of Kabat. In some examples, the Fc region contains the sequence of amino acid sequence set forth in any of SEQ ID NOS: 632-634 or a sequence of amino acids that exhibits at least 90%, 91%, 92%, 93%, 94%, 95%, 96%, 97%, 98%, 99% or more sequence identity to any of SEQ ID NOS:632-634 and contains the amino acid substitutions. In some of any of the provided embodiments, the Fc region contains the sequence of amino acid sequence set forth in SEQ ID NOS: 474 or 637, or a sequence of amino acids that exhibits at least 90%, 91%, 92%, 93%, 94%, 95%, 96%, 97%, 98%, 99% or more sequence identity to SEQ ID NOS: 474 or 637 and contains the amino acid substitutions.

In some of any of the provided embodiments, the variant ICOSL polypeptide is linked, directly or indirectly via a linker, to the variant Fc region. In some examples, the linker contains 1 to 10 amino acids. In some of any of the provided embodiments, the linker is selected from AAA, G4S (SEQ ID NO: 636), $(G_4S)_2$ (SEQ ID NO: 229) or GSGGGGS linker (SEQ ID NO: 635). In some of any of the provided embodiments, the linker is $(G_4S)_3$ (SEQ ID NO: 228).

In some of any of the provided embodiments, the linker is AAA. In some of any of the provided embodiments, the linker is G4S (SEQ ID NO:636). In some of any of the provided embodiments, the linker is $(G_4S)_2$ (SEQ ID NO:229). In some of any of the provided embodiments, the linker is GSGGGGS linker (SEQ ID NO: 635).

In some of any of the provided embodiments of a fusion protein, e.g. a variant ICOSL-Fc fusion protein, the variant ICOSL polypeptide is or comprise an IgV domain. In some of any of the provided embodiments, the variant ICOSL polypeptide contains amino acid modifications N52H/Q100R. In some of any of the provided embodiments, the variant ICOSL polypeptide has the sequence set forth in SEQ ID NO: 567. In some of any of the provided embodiments, the variant ICOSL polypeptide comprises amino acid modifications N52H/N57Y/Q100R. In some of any of the provided embodiments, the variant ICOSL polypeptide has the sequence set forth in SEQ ID NO: 565. In some of any of the provided embodiments, the variant ICOSL polypeptide comprises amino acid modifications are N52L/N57H/Q100R. In some of any of the provided embodiments, the variant ICOSL polypeptide has the sequence set forth in SEQ ID NO: 761. In some of any of the provided embodiments, the variant ICOSL polypeptide comprises amino acid modifications N52H/N57Y/Q100P. In some of any of the provided embodiments, the variant ICOSL polypeptide has the sequence set forth in SEQ ID NO: 570. In some of any of the provided embodiments, the variant ICOSL polypeptide comprises the amino acid modification is N52D. In some of any of the provided embodiments, the polypeptide has the sequence set forth in SEQ ID NO: 548.

In some of any of the provided embodiments, provided is a variant ICOSL-Fc fusion protein that has the sequence of amino acids set forth in SEQ ID NO: 928. In some of any of the provided embodiments, provided is a variant ICOSL-Fc fusion protein that has a sequence of amino acids that has at least 85%, 86%, 87%, 88%, 89%, 90%, 91%, 92%, 93%, 94%, 95%, 96%, 97%, 98%, 99% or more sequence identity to the sequence set forth in SEQ ID NO: 928.

In particular embodiments, the provided immunomodulatory proteins, such as fusion proteins, e.g. variant ICOSL-Fc fusion proteins, binds CD28 and ICOS. In some embodiments, the variant ICOSL-Fc fusion protein exhibits increased binding affinity to CD28 and/or ICOS compared to a human wild-type ICOSL-Fc fusion protein, e.g. containing an ICOSL IgV portion set forth in SEQ ID NO:545 linked via a linker, e.g. set forth in SEQ ID NO:229, to an Fc region. In such an example, the Fc region is an inert or effectorless Fc containing the mutations L234A, L235E and L235E in a human IgG1 Fc, e.g. set forth in SEQ ID NO:637, Provided herein is an immunomodulatory protein containing any of the variant ICOSL polypeptides linked to a second polypeptide comprising an immunoglobulin superfamily (IgSF) domain. In some cases, the IgSF domain is affinity modified and exhibits altered binding to one or more of its cognate binding partner(s) compared to the unmodified or wild-type IgSF domain. In some of any of the provided embodiments, the IgSF domain exhibits increased binding to one or more of its cognate binding partner(s) compared to the unmodified or wild-type IgSF domain.

In some of any of the provided embodiments, the variant ICOSL polypeptide is a first ICOSL variant polypeptide and the IgSF domain of the second polypeptide is an IgSF domain from a second variant ICOSL polypeptide provided herein, wherein the first and second ICOSL variant are the same or different.

In some of any of the provided embodiments, the variant ICOSL polypeptide is capable of specifically binding to CD28 or ICOS and the IgSF domain of the second polypeptide is capable of binding to a binding partner other than one specifically bound by the ICOSL variant polypeptide. In some of any of the provided embodiments, the IgSF domain is from a member of the B7 family.

In some of any of the provided embodiments, the IgSF domain is a tumor-localizing moiety that binds to a ligand expressed on a tumor or is an inflammatory-localizing moiety that binds to a ligand expressed on a cell or tissue of an inflammatory environment. In some cases, the ligand is B7H6. In some examples, the IgSF domain is from NKp30.

In some of any of the provided embodiments, the IgSF domain of the second polypeptide is or comprises an IgV domain. In some of any of the provided embodiments, the IgSF domain of the second polypeptide is a variant NKp30 molecule containing L30V/A60V/S64P/S86G. In some of any of the provided embodiments, the IgSF domain of the second polypeptide has the sequence set forth in SEQ ID NO: 504.

In some of any of the provided embodiments, the IgSF domain is or comprises an IgV domain. In some cases, the variant ICOSL polypeptide is or contains an IgV domain.

In some of any of the provided embodiments, the variant ICOSL polypeptide is or comprise an IgV domain. In some of any of the provided embodiments, the variant ICOSL polypeptide contains amino acid modifications N52H/Q100R. In some of any of the provided embodiments, the variant ICOSL polypeptide has the sequence set forth in SEQ ID NO: 567. In some of any of the provided embodiments, the variant ICOSL polypeptide comprises amino acid modifications N52H/N57Y/Q100R. In some of any of the provided embodiments, the variant ICOSL polypeptide has the sequence set forth in SEQ ID NO: 565. In some of any of the provided embodiments, the variant ICOSL polypeptide comprises amino acid modifications are N52L/N57H/Q100R. In some of any of the provided embodiments, the variant ICOSL polypeptide has the sequence set forth in SEQ ID NO: 761. In some of any of the provided embodiments, the variant ICOSL polypeptide comprises amino acid modifications N52H/N57Y/Q100P. In some of any of the provided embodiments, the variant ICOSL polypeptide has the sequence set forth in SEQ ID NO: 570. In some of any of the provided embodiments, the variant ICOSL polypeptide comprises the amino acid modification is N52D. In some of any of the provided embodiments, the polypeptide has the sequence set forth in SEQ ID NO:548.

In some of any of the provided embodiments, the immunomodulatory protein comprises a multimerization domain linked to one or both of the variant ICOSL polypeptide or the second polypeptide comprising the IgSF domain. In some cases, the multimerization domain is an Fc domain or a variant thereof with reduced effector function.

In some of any of the provided embodiments, the immunomodulatory protein is dimeric. In some cases, the immunomodulatory protein is homodimeric. In some aspects, the immunomodulatory protein is heterodimeric.

Provided herein is a conjugate containing any of the provided variant ICOSL polypeptides or any of the provided immunomodulatory protein and a heterologous moiety. In some cases, the variant ICOSL polypeptide is linked, directly or indirectly via a linker, to the heterologous moiety. In some of any of the provided embodiments, the targeting moiety is a protein, a peptide, nucleic acid, small molecule or nanoparticle. In some examples, the target moiety is a protein or a peptide. In some of any of the provided embodiments, the conjugate is a fusion protein.

Provided is a fusion protein containing any of the provided variant ICOSL polypeptides or any of the provided immunomodulatory protein and a heterologous moiety. In some cases, the moiety is a targeting moiety that specifically binds to a molecule on the surface of a cell. In some examples, the targeting moiety specifically binds to a molecule on the surface of an immune cell. In some of any of the provided embodiments, the immune cell is an antigen presenting cell or a lymphocyte. In some cases, the targeting moiety is a tumor-localizing moiety that binds to a molecule on the surface of a tumor.

In some of any of the provided embodiments, the targeting moiety binds to a molecule HER1/EGFR, HER2/ERBB2, CD20, CD25 (IL-2Rα receptor), CD33, CD52, CD133, CD206, CEA, CEACAM1, CEACAM3, CEACAM5, CEACAM6, cancer antigen 125 (CA125), alpha-fetoprotein (AFP), Lewis Y, TAG72, Caprin-1, mesothelin, PDGF receptor (PDGFR; such as PDGF-R α), PD-1, PD-L1, CTLA-4, IL-2 receptor, vascular endothelial growth factor (VEGF), CD30, EpCAM, EphA2, Glypican-3, gpA33, mucins, CAIX, PSMA, folate-binding protein, gangliosides (such as GD2, GD3, GM1 and GM2), VEGF receptor (VEGFR), VEGFR2, VEGF-A, integrin αVβ3, integrin α5β1, ERBB3, MET, IGF1R, EPHA3, TRAILR1, TRAILR2, RANKL, FAP, tenascin, AFP, BCR complex, CD3, CD18, CD44, CTLA-4, gp72, HLA-DR 10 β, HLA-DR antigen, IgE, MUC-1, nuC242, PEM antigen, metalloproteinases, Ephrin receptor, Ephrin ligands, HGF receptor, CXCR4, CXCR4, Bombesin receptor, SK-1antigen, Bcr-ab1, RET, MET, TRKB, TIE2, ALK, ROS, EML4-ALK, ROS1, BRAFV600E, SRC, c-KIT, mTOR, TSC1, TSC2, BTK, KIT, BRCA, CDK 4/6, JAK1, JAK2, BRAF, FLT-3, MEK1, MEK2, SMO or B7-H6 (NCR3LG1). In some aspects, the targeting moiety binds to PD-L1.

In some of any of the provided embodiments, the targeting moiety is an antibody or antigen-binding fragment. In some of any of the provided embodiments, the antibody is selected from cetuximab, panitumumab, zalutumumab, nimotuzumab, trastuzumab, Ado-trastuzumab emtansine, Tositumomab (Bexxar®), Rituximab (Rituxan, Mabthera), Ibritumomab tiuxetan (Zevalin), Daclizumab (Zenapax), Gemtuzumab (Mylotarg), Alemtuzumab, CEA-scan Fab fragment, OC125 monoclonal antibody, ab75705, B72.3, Bevacizumab (Avastin®), Afatinib, Axitinib, Bosutinib, Cabozantinib, Ceritinib, Crizotinib, Dabrafenib, Dasatinib, Dinutuximab (Unituxin™), Erlotinib, Everolimus, Ibrutinib, Imatinib, Lapatinib, Lenvatinib, Nilotinib, Olaparib, Olaratumab (Lartruvo™), Palbociclib, Pazopanib, Pertuzumab (Perjeta®), Ramucirumab (Cyramza®), Regorafenib, Ruxolitinib, Sorafenib, Sunitinib, Temsirolimus, Trametinib, Vandetanib, Vemurafenib, Vismodegib, Basiliximab, Ipilimumab, Nivolumab, pembrolizumab, MPDL3280A, Pidilizumab (CT-011), AMP-224, MSB001078C, or MEDI4736, BMS-935559, LY3300054, atezolizumab, avelumab or durvalumab or is an antigen-binding fragment thereof.

In some of any of the provided embodiments, the variant ICOSL polypeptide is linked, directly or indirectly via a linker, to the N-terminus of the heavy and/or light chain of the antibody or antigen-binding fragment. In some cases, the variant ICOSL polypeptide is linked, directly or indirectly via a linker, to the C-terminus of the heavy and/or light chain of the antibody or antigen binding fragment.

In some of any of the provided embodiments, the conjugate is divalent, tetravalent, hexavalent or octavalent. In some of any of the provided embodiments, the heterologous moiety is or contains a label for detection or purification of the variant ICOSL polypeptide.

Provided herein is a monovalent fusion protein containing a variant ICOSL polypeptide containing one or more amino acid modifications in an immunoglobulin superfamily (IgSF) domain of an ICOSL reference polypeptide, wherein the variant ICOSL polypeptide exhibits altered binding to the ectodomain(s) of ICOS or CD28 compared to the binding of the ICOSL reference polypeptide for the same ectodomain(s); and a label for detection or purification of the variant ICOSL polypeptide. In some of any of the provided embodiments, the label for detection or purification is selected from a poly-histidine (His) tag, a FLAG-tag, a Myc-tag, or a fluorescent protein-tag.

In some of any of the provided embodiments, the variant ICOSL polypeptide contains one or more amino acid modifications in a position corresponding to position(s) selected from 10, 11, 13, 16, 18, 20, 25, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 138, 139, 140, 142, 143, 144, 146, 148, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32. In some of any of the provided embodiments, the variant ICOSL polypeptide contains one or more amino acid modifications are in a position corresponding to position(s) selected from 10, 11, 13, 16, 18, 20, 25, 26, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 137, 138, 139, 140, 142, 143, 144, 146, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32.

In some cases, the one or more amino acid modifications are selected from M10V, M10I, V11E, S13G, E16V, S18R, A20V, S25G, F27S, F27C, N30D, Y33del, Q37R, K42E, T43A, Y47H, N52A, N52C, N52D, N52G, N52H, N52K, N52L, N52M, N52Q, N52R, N52S, N52T, N52V, N52Y, N52K, S54A, S54P, N57A, N57D, N57E, N57F, N57H, N57K, N57L, N57M, N57P, N57Q, N57S, N57T, N57V, N57Y, N57W, R61S, R61C, Y62F, L67P, A71T, G72R, L74Q, R75Q, D77G, F78L, L80P, N84Q, E90A, K92R, F93L, H94E, H94D, L96F, L96I, V97A, L98F, S99G, Q100A, Q100D, Q100G, Q100K, Q100L, Q100M, Q100N, Q100P, Q100R, Q100S, Q100T, Q100V, L102R, G103E, V107A, V107I, S109G, S109N, V10D, V10N, V110A, E111del, T113E, H115R, H115Q, V116A, A117T, N119Q, F120I, S121G, V122A, V122M, F120S, S126T, S126R, H129P, S130G, S132F, Q133H, E135K, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193A, V193M, N194D, C198R, N201S, L203F, L203P, N207Q, L208P, V210A, S212G, D217G, D217V, I218N, I218T, E220G, R221G, R221I, R221K, I224V, T225A, T225S, N227K, or a conservative amino acid substitution thereof. In some cases, the one or more amino acid modifications are selected from M10V, M10I, V11E, S13G, E16V, S18R, A20T, A20V, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110A, V110D, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193M, N194D, C198R, N201S, L203P, L203F, N207Q, L208P, V210A, S212G, D217V, I218T, I218N, E220G, R221G, R221I, I224V, T225A, N227K, or a conservative amino acid substitution thereof.

In some of any of the provided embodiments, the ICOSL reference polypeptide contains (i) the sequence of amino acids set forth in SEQ ID NO:32, (ii) a sequence of amino acids that has at least 95% sequence identity to SEQ ID NO:32; or (iii) a portion of (i) or (ii) comprising an IgV domain or IgC domain or specific binding fragments thereof or both.

In some of any of the provided embodiments, the ICOSL reference polypeptide comprises the sequence of amino acids set forth in any of SEQ ID NOS: 196, 545, 600-605 and 623-628. In some aspects, the ICOSL reference polypeptide consists of the sequence of amino acids set forth in any of SEQ ID NOS: 32, 196, 545, 600-605 and 623-628.

Provided is a nucleic acid molecule(s) encoding any of the provided variant ICOSL polypeptides, immunomodulatory proteins, or fusion proteins. In some cases, the nucleic acid molecules(s) is synthetic nucleic acid. In some examples, the nucleic acid molecule(s) is cDNA.

Provided is a vector containing any of the provided the nucleic acid molecule(s). In some cases, the vector is an expression vector. In some of any of the provided embodiments, the vector is a mammalian expression vector or a viral vector.

Provided is a cell containing any of the provided vectors. In some cases, the cell is a mammalian cell. In some of any of the provided embodiments, the cell is a Chinese Hamster Ovary (CHO) cell or a derivative thereof.

Provided is a method of producing an immunomodulatory protein containing any of the variant ICOSL polypeptides, including introducing any of the provided nucleic acid molecules or vectors into a host cell under conditions to express the protein in the cell. In some examples, the host cell is a mammalian cell. In some instances, the mammalian cell is a Chinese Hamster Ovary cell or a derivative thereof. In some of any of the provided embodiments, the method further includes isolating or purifying the protein from the cell.

Provided is a protein produced by any of the provided methods.

Provided is a composition containing a protein containing any of the provided variant ICOSL polypeptides, or immunomodulatory proteins, wherein at least 95%, 96%, 97%, 98%, 99% of the individual sequences of the protein or the immunomodulatory protein in the composition have an identical sequence length, optionally wherein the composition is a pharmaceutical composition comprising a pharmaceutically acceptable carrier. In some of any of the provided embodiments, the protein or immunomodulatory protein is purified from Chinese Hamster Ovary Cells or a derivative thereof.

Provided is a polynucleotide containing a nucleic acid encoding a variant ICOSL polypeptide containing a provided transmembrane domain and one or more nucleic acid encoding one or more chain of a recombinant antigen receptor. In some cases, the recombinant antigen receptor is a chimeric antigen receptor (CAR) or an engineered T cell receptor (TCR). In some of any of the provided embodiments, each of the nucleic acid encoding the variant ICOSL polypeptide and the one or more nucleic acid encoding one or more chain of the recombinant receptor is separated by a nucleic acid encoding a self-cleaving peptide or a peptide that causes ribosome skipping.

In some examples, the polynucleotide contains the nucleic acid encoding the variant ICOSL polypeptide, a nucleic acid encoding a self-cleaving peptide or a peptide that causes ribosome skipping and a nucleic acid encoding a CAR. In some examples, the polynucleotide comprises the nucleic acid encoding the variant ICOSL polypeptide, a nucleic acid encoding a first self-cleaving peptide or a peptide that causes ribosome skipping, a nucleic acid encoding one of an engineered TCRalpha chain or an engineered TCRbeta chain, a nucleic acid encoding a second self-cleaving peptide or a peptide that causes ribosome skipping, and a nucleic acid encoding the other of the engineered TCRalpha chain or the engineered TCRbeta chain. In some aspects, the encoded first and second self-cleaving peptide is the same. In some of any of the provided embodiments, the self-cleaving peptide or the peptide that causes ribosome skipping is a T2A, a P2A, a E2A or a F2A.

Provided is a vector containing any of the provided polynucleotides. In some cases, the vector is a viral vector. In some of any of the provided embodiments, the viral vector is a retroviral vector or a lentiviral vector.

Provided is an engineered cell containing any of the provided polynucleotides or vectors. Also provided is an engineered cell containing any of the provided variant ICOSL polypeptides, immunomodulatory proteins, or fusion proteins.

Provided is an engineered cell containing any of the provided nucleic acid molecules or the vectors. In some cases, the nucleic acid encoding the variant ICOSL polypeptide, immunomodulatory protein or fusion protein encodes a signal peptide. In some of any of the provided embodiments, the variant ICOSL polypeptide, immunomodulatory protein or fusion protein does not contain a transmembrane domain and/or is not expressed on the surface of the cell. In some of any of the provided embodiments, the variant ICOSL polypeptide, immunomodulatory protein or fusion protein is secreted from the engineered cell. In some aspects, the engineered cell contains a variant ICOSL polypeptide containing a transmembrane domain. In some aspects, the variant ICOSL polypeptide is expressed on the surface of the cell.

In some of any of the provided embodiments, the cell is an immune cell. In some cases, the immune cell is an antigen presenting cell (APC) or a lymphocyte. In some examples, the engineered cell is primary cell. In some instances, the cell is a mammalian cell. In some cases, the cell is a human cell. In some of any of the provided embodiments, the lymphocyte is a T cell. In some examples, the engineered cell is an APC and the APC is an artificial APC.

In some of any of the provided embodiments, the engineered cell further contains a chimeric antigen receptor (CAR) or an engineered T-cell receptor.

Provided is an infectious agent containing a nucleic acid molecule encoding a provided variant ICOSL polypeptide or a provided immunomodulatory protein, a provided fusion protein. In some cases, the encoded variant ICOSL polypeptide, immunomodulatory protein or fusion protein does not contain a transmembrane domain and/or is not expressed on the surface of a cell in which it is expressed. In some of any of the provided embodiments, the encoded variant ICOSL polypeptide, immunomodulatory protein or fusion protein is secreted from the infectious agent when it is expressed. In some cases, the encoded variant ICOSL polypeptide comprises a transmembrane domain.

In some of any of the provided embodiments, the encoded variant ICOSL polypeptide is expressed on the surface of a cell in which it is expressed. In some cases, the infectious agent is a bacteria or a virus. In some of any of the provided embodiments, the virus is an oncolytic virus. In some examples, the oncolytic virus is an adenoviruses, adeno-associated viruses, herpes viruses, Herpes Simplex Virus, Vesticular Stomatic virus, Reovirus, Newcastle Disease virus, parvovirus, measles virus, vesticular stomatitis virus (VSV), Coxsackie virus or a Vaccinia virus.

In some of any of the provided embodiments, the virus specifically targets dendritic cells (DCs) and/or is dendritic cell-tropic. In some cases, the virus is a lentiviral vector that is pseudotyped with a modified Sindbis virus envelope product. In some of any of the provided embodiments, the infectious agent further contains a nucleic acid molecule encoding a further gene product that results in death of a target cell or that can augment or boost an immune response. In some of any of the provided embodiments, the further gene product is selected from an anticancer agent, anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or a reprogramming human somatic cells to pluripotency.

Provided is a pharmaceutical composition containing any of the variant ICOSL polypeptides, immunomodulatory proteins, conjugates or fusion proteins or any of the provided engineered cells or infectious agents. In some of any of the provided embodiments, the pharmaceutical composition contains a pharmaceutically acceptable excipient. In some of any of the provided embodiments, the pharmaceutical composition is sterile.

In some of any of the provided embodiments, provided is an article of manufacture containing the pharmaceutical composition in a vial. In some cases, the vial is sealed.

Provided is a kit containing any of the provided compositions and instructions for use. Also provided is a kit containing any of the provided articles of manufacture and instructions for use.

Provided is a method of modulating an immune response in a subject, including administering the pharmaceutical composition to the subject. Also provided is a method of modulating an immune response in a subject including administering the engineered cells. In some cases, the engineered cells are autologous to the subject. In some of any of the provided embodiments, the engineered cells are allogenic to the subject.

In some of any of the provided embodiments, the modulating the immune response treats a disease or condition in the subject. In some aspects, the immune response is increased.

In some of any of the provided embodiments, an immunomodulatory protein or conjugate containing a variant ICOSL polypeptide linked to a tumor-localizing moiety is administered to the subject. In some cases, the tumor-localizing moiety is or comprises a binding molecule that recognizes a tumor antigen. In some of any of the provided embodiments, the binding molecule contains an antibody or an antigen-binding fragment thereof or comprises a wild-type IgSF domain or variant thereof. In some of any of the provided embodiments, the immunomodulatory protein or the conjugate or fusion protein is administered to the subject.

In some of any of the provided embodiments, a variant ICOSL polypeptide that is a transmembrane immunomodulatory protein is administered to the subject. In some cases, the engineered cell containing a variant ICOSL polypeptide that is a transmembrane immunomodulatory protein is administered to the subject. In some of any of the provided embodiments, the disease or condition is a tumor or cancer. In some examples, the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some of any of the provided embodiments, the immune response is decreased.

In some of any of the provided embodiments, a variant ICOSL polypeptide or immunomodulatory protein that is soluble is administered to the subject. In some of any of the provided embodiments, the soluble immunomodulatory protein is an immunomodulatory Fc fusion protein. In some of any of the provided embodiments, a provided variant ICOSL polypeptide, immunomodulatory protein, or fusion protein is administered to the subject. In some of any of the provided embodiments, an engineered cell containing a secretable variant ICOSL polypeptide is administered to the subject. In some of any of the provided embodiments, a provided engineered cell is administered to the subject. In some of any of the provided embodiments, an infectious agent encoding a variant ICOSL polypeptide that is a secretable immunomodulatory protein is administered to the subject, optionally under conditions in which the infectious agent infects a tumor cell or immune cell and the secretable immunomodulatory protein is secreted from the infected cell. In some of any of the provided embodiments, the disease or condition is an inflammatory or autoimmune disease or condition. In some examples, the disease or condition is an Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease. In some cases, the disease or condition is selected from inflammatory bowel disease, transplant, Crohn's disease, ulcerative colitis, multiple sclerosis, asthma, rheumatoid arthritis, or psoriasis.

BRIEF DESCRIPTION OF THE DRAWINGS

FIGS. 3A-3B demonstrate, via cytokine release, the costimulatory capacity of wild-type (WT) or variant ICOSL when coimmobilized with anti-CD3. 10 nM anti-CD3 was wet coated to the wells of 96-well flat bottomed polystyrene tissue culture plates with 40 nM (arrows) or 10 nM WT or variant ICOSL. 100,000 purified CD4$^+$ and CD8$^+$ (pan) T-cells cells were added and supernatant was harvested 72 hours later for ELISA analysis for cytokine release. FIG. 3A shows IFN-gamma and FIG. 3B shows IL-17 protein levels secreted from pan T-cells. Graphs are representative of typical IFN-gamma and IL-17 responses from pan T-cell costimulation.

FIGS. 4A-4B demonstrate, via proliferation, the costimulatory capacity of wild-type (WT) or variant ICOSL when coimmobilized with anti-CD3. CFSE-labeled pan T-cells were incubated in anti-CD3 and ICOSL coated plates as previously described for 72 hours. Cells were harvested, washed, stained with fluorescently conjugated anti-CD4 or anti-CD8 antibodies, and analyzed by flow cytometry. Gates and cytometer voltages were set using non-stimulated control CFSE-labeled T-cells. Proliferation was determined by CFSE dilution from control. FIG. 4A shows percent of total proliferating (arrows), CD4$^+$ (solid bar), and CD8$^+$ cells (hatched bar) T-cells following 40 nM ICOSL costimulation. FIG. 4B shows percent of total pan T-cell proliferation following 10 nM ICOSL costimulation. Graphs are representative of typical proliferative response from pan T-cell costimulation.

FIG. 6A depicts soluble ICOSL Fc-fusion proteins inhibition of T cell-driven B cell proliferation. Purified CD4+ T cells and B cells from a single donor were CFSE-labeled and co-incubated at a 1:1 ration in the presence or absence of the indicated mitogens with or without the indicated ICOSL Fc-fusion proteins. Cells were stimulated with Staph enterotoxin B (SEB) at 100 ng/mL, Pokeweed mitogen (PWM) at 1 mg/mL, or both. ICOSL Fc-fusion proteins were included at a final concentration of 40 nM and cultures were incubated for 7 days and subjected to FACS analysis. The number of divided B cells was determined from the number of cells in the cultures that had diluted their CFSE. All of the ICOSL Fc-fusion proteins tested except for wild-type reduced B cell proliferation. FIGS. 6B-6D show ICOSL Fc-fusion proteins inhibited cytokine T cell cytokine production in B-T co-cultures. Supernatants from the cultures described above were harvested on day 7 and analyzed for cytokine content using a LEGENDplex Human Th Cytokine Panel (Biolegend). T cell production of IL-5 (FIG. 6B), IL-13 (FIG. 6C) and IL-21 (FIG. 6D) is attenuated by inclusion of ICOSL Fc-fusion proteins.

FIG. 7A shows survival curves of the treated animals. Aggressive disease course and subsequent mortality was observed in the saline control animals, with similar survival observed in the animals treated with wild-type ICOSL-Fc, as well as the N52H/I143T ICOSL variant. Variant N52H/N57Y/Q100P had improved survival rates comparable to the clinical benchmark belatacept. FIG. 7B shows similar trends in body weight loss, with ICOSL variant N52H/N57Y/Q100P demonstrating similar weight maintenance as animals treated with belatacept, even though all other groups experienced rapid weight loss. FIG. 7C shows clinical scores from standardized GVHD Disease Activity Index (DAI) observations, again showing lower scores in animals treated with the ICOSL variant N52H/N57Y/Q100P that are comparable to the clinical benchmark belatacept while the other groups of animals experienced higher DAI scores. FIG. 7D depicts a flow cytometric measurement of CD4 and CD8 percentages in blood from experimental animals measured on day 14. The percentage of CD8 cells between experimental groups was largely the same, however, animals treated with ICOSL variant N52H/N57Y/Q100P and belatacept have lower percentages of CD4 cells compared to the other experimental groups.

FIG. 7E depicts survival curves from a similar experiment testing additional ICOSL variant molecules. FIG. 7F depicts clinical scores from a similar experiment testing additional ICOSL variant molecules.

FIG. 10A shows various configurations in which a vIgD is linked, directly or indirectly, to the N- and/or C-terminus of the light chain of an antibody. FIG. 10B shows various configurations in which a vIgD is linked, directly or indirectly, to the N- and/or C-terminus of the heavy chain of an antibody. FIG. 10C depicts the resulting V-Mab configurations when a light chain of FIG. 10A and a heavy chain of FIG. 10B are co-expressed in a cell.

FIGS. 11A-11B demonstrate V-Mab specificity for cognate binding partners. Binding assays were performed on Expi293 cells transiently transfected with DNA for mammalian surface expression of human HER2, CD28, CTLA-4, or ICOS. 200,000 transfected cells were incubated with 100,000 pM to 100 pM parental antibody (C1) or various V-Mabs (C2-9). Unbound antibody was removed, bound antibody detected with fluorescently conjugated anti-human IgG, and the cells were analyzed by flow cytometry for MFI and percentage positive based on Fc controls. FIG. 11A shows binding of the V-Mabs to HER2 transfectants at levels similar to the parental antibody. Binding to mock transfected cells is observed with all V-Mabs, though not WT ICOSL, due to low levels of endogenous HER2 expression on Expi293 parental cells. FIG. 11B shows binding of the parental IgSF-domain (N52H/N57Y/Q100P) to its cognate partners is maintained or increased (C2, C3, C4, C5, C6, C8, C9) by V-Mabs.

FIG. 13A depicts soluble molecules, including: (1) a variant IgSF domain (vIgD) fused to an Fc chain; (2) a stack molecule containing a first variant IgSF domain (first vIgD) and a second IgSF domain, such as a second variant IgSF domain (second vIgD); (3) a tumor targeting IgSF molecule containing a first variant IgSF domain (vIgD) and an IgSF domain that targets to a tumor antigen, such as an NKp30 IgSF domain; and (4) a variant IgSF domain (vIgD) linked to an antibody (V-Mab). FIG. 13B depicts a transmembrane immunomodulatory protein (TIP) containing a variant IgSF domain (vIgD), e.g., variant ICOSL, expressed on the surface of a cell. In an exemplary embodiment, the cognate binding partner of the transmembrane bound vIgD is a costimulatory receptor, e.g. CD28, and the TIP containing the vIgD (e.g. ICOSL vIgD) agonizes the costimulatory receptor such that the TIP induces a positive signal in the cell expressing the costimulatory receptor. FIG. 13C depicts a secreted immunomodulatory protein (SIP) in which a variant IgSF domain (vIgD), e.g., variant ICOSL, is secreted from a cell, such as a first T cell (e.g. CAR T cell). In an exemplary embodiment, the cognate binding partner of the secreted vIgD is an activating receptor, e.g., CD28, which can be expressed on the first cell (e.g., T cell, such as a CAR T cell) and/or on a second cell (e.g. T cell; either endogenous or engineered, such as a CAR T cell). Upon binding of the SIP with its cognate binding partner, signaling via the activating receptor is blocked. In all cases, the vIgD can be a V-domain (IgV) only, the combination of the V-domain (IgV) and C-domain (IgC), including the entire extracellular domain (ECD), or any combination of Ig domains of the IgSF superfamily member.

FIGS. 20A-20B demonstrates VmAb mediated T-cell proliferation when co-cultured with HER2 expressing targets. CFSE-labeled pan T-cells were activated with K562-derived artificial target cells displaying cell surface anti-CD3 single chain Fv (OKT3) and HER2 in the presence of VmAbs or control proteins. Proliferation was measured by flow cytometric analysis of CFSE-dilution on CD4$^+$ (left panel) or CD8$^+$ (right panel) stained T-cells. In FIG. 20A, K562 cells were titrated and plated with T-cells for an effector:target (E:T) ratio of 40 to 1280:1. VmAbs, parental IgSF domain, or WT ICOSL were added at 1000 pM. In FIG. 20B, K562 cells were added to T-cells for an E:T ratio of 160:1. VmAbs or control proteins were titrated and added at 3000 to 37 pM.

FIGS. 22A-22G shows SEC analysis of proteolysis in variant ICOSL Fc-fusion molecules containing mutations N52H/N57Y/Q100R/F172S generated in various reference sequences, such as truncated ICOSL ECD Fc-fusion, an ICOSL IgV domain alone Fc-fusion, and/or ICOSL variant Fc fusion proteins with mutations at N207G/L208G with reference to the reference ICOSL extracellular domain (ECD) sequence set forth in SEQ ID NO:32. Molecules were expressed using ExpiCHO-S derived cells.

FIGS. 24B-24F depicts results of VmAb costimulation of T cells using a transfected cell system using Jurkat cells with an IL-2 promoter luciferase reporter, showing that V-mAbs provided a significant costimulatory signal in the presence of HER2+ K562/OKT3 cells.

FIGS. 30A-30D depicts anti-inflammatory activity of delayed dosing of the exemplary ICOSL IgV-Fc fusion molecule in the collagen-induced arthritis (CIA) model, including mean sum paw score (FIG. 30A) and serum cytokine levels (FIGS. 30C-30D).

FIGS. 33A-33F depicts results from flow cytometric analysis of Graft-versus-Host-Disease (GvHD) ratio of human cells/mouse cells in blood collected (FIG. 33A) or in total T cell count (FIG. 33B) at the end of the study, and assessment of ICOS+ CD4+ or CD8+ cells (FIGS. 33C-33D), or CD28+ CD4+ or CD8+ cells (FIGS. 33E-33F) from Graft-versus-Host-Disease (GvHD) mice treated with various doses (20, 100, or 500 µg) of a variant ICOSL IgV-Fc molecule.

FIG. 34C depicts the ratio of T effector cells (Teff) to T regulatory cells (Treg) from Graft-versus-Host-Disease (GvHD) mice treated with various doses (20, 100, or 500 µg) of a variant ICOSL IgV-Fc molecule.

DETAILED DESCRIPTION

Figure 1:
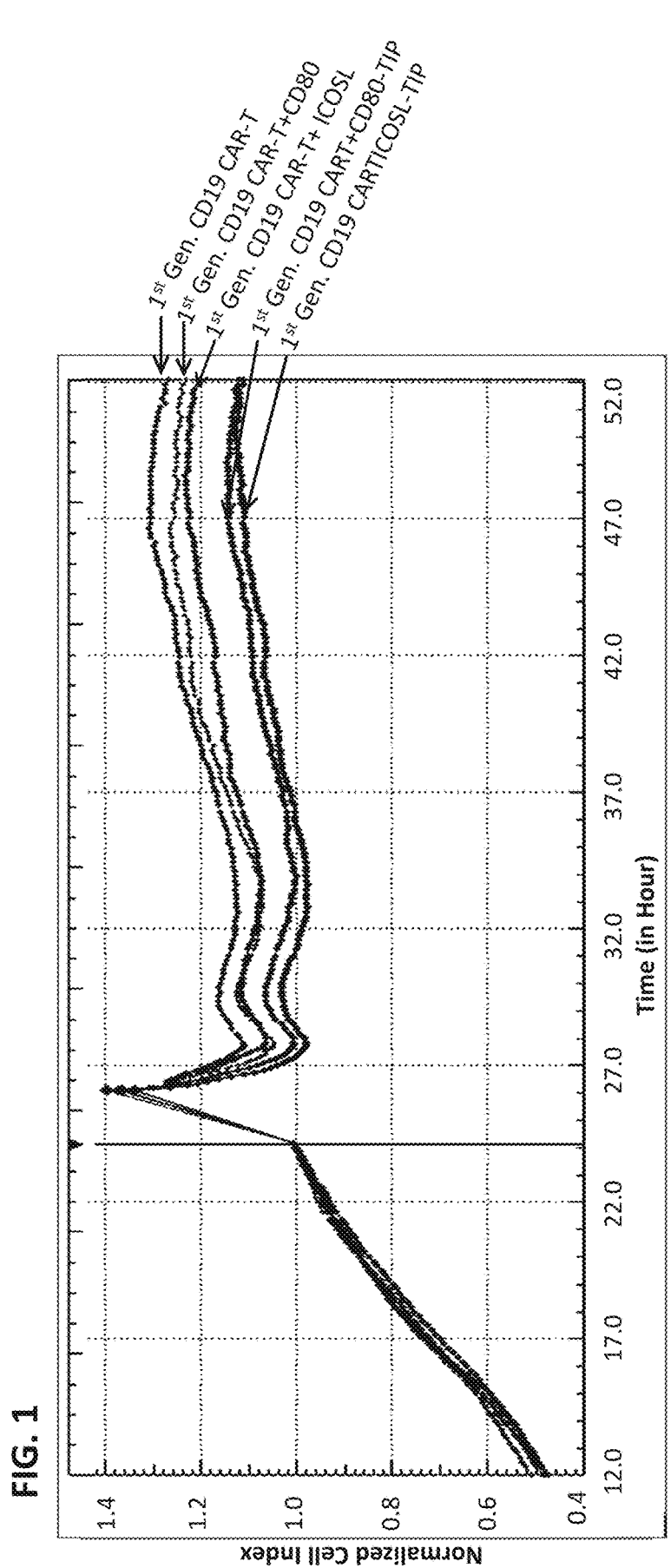
FIG. 1 depicts impedance results reflecting cytotoxic killing activity of cells engineered with an anti-CD19 chimeric antigen receptor (CAR) alone or with an exemplary transmembrane immunomodulatory TIP (CD80-TIP or ICOSL-TIP) or the corresponding CD80 or ICOSL wild-type transmembrane protein following co-culture with target antigen-expressing cells. Impedance was assessed using the Acea Real-Time Cell Analyzer (RTCA), which measures the impedance variations in the culture media of a 96-well microelectronic plate (E-plate).

Provided herein are immunomodulatory proteins that are or comprise variants or mutants of ICOS ligand (ICOSL) or specific binding fragments thereof that exhibit activity to bind to at least one target ligand cognate binding partner (also called counter-structure protein). In some embodiments, the variant ICOSL polypeptides contain one or more amino acid modifications (e.g. amino acid substitutions, deletions or additions) compared to a reference (e.g., unmodified) or wild-type ICOSL polypeptide. In some embodiments, the one or more amino acid modifications (e.g. amino acid substitutions, deletions or additions) are in an immunoglobulin superfamily (IgSF) domain (e.g. IgV) of a reference (e.g., unmodified) or wild-type ICOSL polypeptide. In some embodiments, the variant ICOSL polypeptide exhibits altered, such as increased or decreased, binding activity or affinity for at least one cognate binding partner, such as at least one of ICOS, CD28, or CTLA-4. In some embodiments, the immunomodulatory proteins are soluble. In some embodiments, the immunomodulatory proteins are transmembrane immunomodulatory proteins capable of being expressed on the surface of cells. In some embodiments, also provided herein are one or more other immunomodulatory proteins that are conjugates or fusions containing a variant ICOSL polypeptide provided herein and one or more other moiety or polypeptide.

In some embodiments, the variant ICOSL polypeptides and immunomodulatory proteins modulate an immunological immune response, such as an increased or decreased immune response. In some embodiments, the variant ICOSL polypeptides and immunomodulatory proteins provided herein can be used for the treatment of diseases or conditions that are associated with a dysregulated immune response.

In some embodiments, the provided variant ICOSL polypeptides modulate T cell activation via interactions with costimulatory signaling molecules. In general, antigen specific T-cell activation requires two distinct signals. The first signal is provided by the interaction of the T-cell receptor (TCR) with major histocompatibility complex (MHC) associated antigens present on antigen presenting cells (APCs). The second signal is costimulatory to TCR engagement and necessary to avoid T-cell apoptosis or anergy.

In some embodiments, under normal physiological conditions, the T cell-mediated immune response is initiated by antigen recognition by the T cell receptor (TCR) and is regulated by a balance of co-stimulatory and inhibitory signals (e.g., immune checkpoint receptors). The immune system relies on immune checkpoint receptors to prevent autoimmunity (i.e., self-tolerance) and to protect tissues from excessive damage during an immune response, for example during an attack against a pathogenic infection. In some cases, however, these immunomodulatory proteins can be dysregulated in diseases and conditions, including tumors, as a mechanism for evading the immune system.

In some embodiments, among known T-cell costimulatory receptors is CD28, which is the T-cell costimulatory receptor for the ligands B7-1 (CD80) and B7-2 (CD86) both of which are present on APCs. These same ligands can also bind to the inhibitory T-cell receptor CTLA4 (cytotoxic T-lymphocyte-associated protein 4) with greater affinity than for CD28; the binding to CTLA-4 acts to down-modulate the immune response. ICOS (inducible costimulator) is another T-cell costimulatory receptor which binds to ICOS ligand (ICOSL) on APCs. In some cases, CD28 and CTLA-4 also are known to interact with ICOSL at a binding site that overlaps with the binding of ICOSL to the T-cell costimulatory receptor ICOS (Yao et al. (2011) Immunity, 34:729-740). Although CD28 and ICOS are related CD28 family activating receptors and share some intracellular signaling motifs, costimulatory effects between CD28 and ICOS differ. For example, CD28 is expressed on both unactivated and activated T cells and its signaling is important for IL-2 production and subsequent T cell effector function. ICOS is generally not expressed on the surface of T cells until after T cell activation, and signaling through ICOS on activated T cells supports specialized T cell subset differentiation. Thus, in some cases, costimulation by CD28 and ICOS yields overlapping and complementary effects.

In some aspects, T cells express the costimulatory molecules CD28 and ICOS, which interact with CD80/CD86 and ICOSL respectively, on antigen presenting cells (APC). In lymphoid organs, professional APC (i.e. dendritic cells, macrophages, and B cells) express CD80, CD86, and ICOSL and engage CD28+/ICOS+ T cells. In some embodiments, activated T cells can then differentiate into effector cells such as CD8+ cytotoxic T cells (CTL), IL-17A/F-secreting CD4+ Th17 cells, or CD4+ follicular helper ($T_{FH}$) cells. $T_{FH}$-expressing CD40L engage B cells in lymphoid follicles and release cytokines (e.g. IL-21) inducing differentiation of B cells to antibody (Ab)-secreting plasma cells. Plasma cells can produce tissue-damaging antibodies, e.g., rheumatoid factor (RF) and anti-citrullinated peptide antibodies (ACPA) in humans, and anti-collagen (CII) antibodies in mice, which can form immune complexes and deposits in the joints and other tissues. ICOSL can also be expressed on non-professional APCs, leading to T cell activation in non-lymphoid tissues and further damage to the tissues and joints.

In some aspects, CD4+Th1-, Th9- and Th17-cells, are implicated as key contributors to multiple sclerosis (MS) by increasing inflammation within the CNS in both multiple sclerosis and experimental autoimmune encephalomyelitis and CD4+ICOS+CXCR5+ T follicular helper cells are increased in PBMC in relapsing-remitting and correlate with disease progression in secondary progressive MS. In some embodiments, there is significantly increased ICOS gene expression in cerebrospinal fluid cells, in secondary progressive MS, and an increased percentage of total monocytes and monocytes expressing ICOSL is observed. ICOSL also expressed on non-professional APCs, leading to T cell activation in non-lymphoid tissues and further tissue damage Among the provided variant ICOSL polypeptide are polypeptides that, when modified by one or more amino acid modifications of an IgSF domain of a reference ICOSL polypeptide, exhibit enhanced binding affinity for CD28 and/or ICOS. In some cases, the overall increase in ICOS binding in provided variants is less than the increase in CD28 binding because wild-type ICOSL already demonstrates substantially more binding affinity for ICOS than CD28. Also provided are various formats of the provided variant polypeptides. As shown herein, alternative formats can facilitate manipulation of the immune response, and hence the therapeutic application. For example, delivery of enhanced ICOSL proteins in soluble formats is shown herein to antagonize T cell activation by inhibiting CD28 and/or ICOS signaling. In other examples, tethering of the variant ICOSL molecules to a surface facilitates T cell activation by providing a costimulatory signal. Various tethering strategies are provided to localize delivery of a T cell costimulatory signal including, but not limited to, direct coating to plastic, use of another variant IgSF domain to localize to a plate-bound or cell surface expressed protein target, or fusion of the variant ICOSL to a tumor-specific monoclonal antibody.

In some embodiments, the modulation of immune signaling achieved by the provided variant ICOSL polypeptides and immunomodulatory polypeptides offers advantages for treatment of inflammatory and autoimmune disorders and other diseases and conditions compared to other treatments. In some cases, therapies to intervene and alter the costimulatory effects of both receptors are constrained by the spatial orientation requirements as well as size limitations imposed by the confines of the immunological synapse. In some aspects, existing therapeutic drugs, including antibody drugs, may not be able to interact simultaneously with the multiple target proteins involved in modulating these interactions. In addition, in some cases, existing therapeutic drugs may only have the ability to antagonize but not agonize an immune response. Additionally, pharmacokinetic differences between drugs that independently target one or the other of these two receptors can create difficulties in properly maintaining a desired blood concentration of such drug combinations throughout the course of treatment.

In some embodiments, the provided variant ICOSL polypeptides or immunomodulatory proteins modulate (e.g. increase or decrease) immunological activity induced by costimulatory receptors CD28 or ICOS. Thus, in some embodiments, the provided polypeptides overcome these constraints by providing variant ICOSL (inducible costimulator ligand) with altered (e.g. increased or decreased) binding affinities to both CD28 and ICOS, and, in some cases, CTLA-4, thereby agonizing or antagonizing the complementary effects of costimulation by receptors. Methods of making and using these variant ICOSL are also provided.

In some aspects, the provided molecules may also be more effective than other soluble therapeutic protein agents. For example, abatacept (CTLA-4-Fc) has been shown to interfere with T cell costimulation to attenuate T cell responses in autoimmune disease settings, such as for the treatment of rheumatoid arthritis, psoriatic arthritis and juvenile idiopathic arthritis, and belatacept, a variant CTLA-4-Fc molecule, for transplant rejection. These CTLA-4-Fc proteins, however, bind to CD80 and CD86 and prevent these costimulatory ligands from engaging and triggering only CD28. Variant ICOSL polypeptides provided herein, in some cases, exhibit binding affinity and enhanced activity for both CD28 and ICOS.

Furthermore, the ability to format the variant polypeptides in various configurations to, depending on the context, antagonize or agonize an immune response, offers flexibility in therapeutic applications based on the same increased binding and activity of a variant ICOSL for binding partners. In some embodiments, the particular format can be chosen for the desired therapeutic application. For example, as described, an immunomodulatory polypeptide comprising a variant ICOSL polypeptide is provided in a format, e.g. as an Fc-fusion protein, to antagonize or block activity of its cognate binding partner, e.g. ICOS and/or CD28. In some embodiments, blocking or inhibiting costimulatory signaling via CD28 or ICOS may be useful to suppresses an immune response, which can be useful in the treatment of inflammatory or autoimmune disorders (e.g., multiple sclerosis or brain inflammation), or organ transplantation. As an example, tethering variant ICOSL proteins to a surface can deliver a localized costimulatory signal, which, in some aspects, can be used to target tumor tissue to deliver localized costimulation to tumor infiltrating T cells. Most primary tumors lack expression of costimulatory molecules such as CD80, CD86 or ICOSL, and thus T cell anti-tumor responses can be compromised by a lack of costimulation (Yu et al. (1998) Int. Immunol. 10:791-797). By localizing costimulatory domains to tumor cells using a tumor-localizing moiety, such as Nkp30 localized to B7H6 tumor cells or a tumor-specific antibody, T cell responses can be enhanced in the absence of tumor-expressed costimulatory proteins.

All publications, including patents, patent applications scientific articles and databases, mentioned in this specification are herein incorporated by reference in their entirety for all purposes to the same extent as if each individual publication, including patent, patent application, scientific article or database, were specifically and individually indicated to be incorporated by reference. If a definition set forth herein is contrary to or otherwise inconsistent with a definition set forth in the patents, applications, published applications and other publications that are herein incorporated by reference, the definition set forth herein prevails over the definition that is incorporated herein by reference.

The section headings used herein are for organizational purposes only and are not to be construed as limiting the subject matter described.

I. DEFINITIONS

Unless defined otherwise, all terms of art, notations and other technical and scientific terms or terminology used herein are intended to have the same meaning as is commonly understood by one of ordinary skill in the art to which the claimed subject matter pertains. In some cases, terms with commonly understood meanings are defined herein for clarity and/or for ready reference, and the inclusion of such definitions herein should not necessarily be construed to represent a substantial difference over what is generally understood in the art.

The terms used throughout this specification are defined as follows unless otherwise limited in specific instances. As used in the specification and the appended claims, the singular forms "a," "an," and "the" include plural referents unless the context clearly dictates otherwise. Unless defined otherwise, all technical and scientific terms, acronyms, and abbreviations used herein have the same meaning as commonly understood by one of ordinary skill in the art to which the invention pertains. Unless indicated otherwise, abbreviations and symbols for chemical and biochemical names is per IUPAC-IUB nomenclature. Unless indicated otherwise, all numerical ranges are inclusive of the values defining the range as well as all integer values in-between.

The term "affinity modified" as used in the context of an immunoglobulin superfamily domain, means a mammalian immunoglobulin superfamily (IgSF) domain having an altered amino acid sequence (relative to the corresponding wild-type parental or unmodified IgSF domain) such that it has an increased or decreased binding affinity or avidity to at least one of its cognate binding partners (alternatively "counter-structures") compared to the parental wild-type or unmodified (i.e., non-affinity modified) IgSF control domain. Included in this context is an affinity modified ICOSL IgSF domain. In some embodiments, the affinity-modified IgSF domain can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions, in a reference (e.g., unmodified) or wild-type IgSF domain. An increase or decrease in binding affinity or avidity can be determined using well known binding assays such as flow cytometry. Larsen et al., American Journal of Transplantation, Vol 5: 443-453 (2005). See also, Linsley et al., Immunity, Vol 1: 793-801 (1994). An increase in a protein's binding affinity or avidity to its cognate binding partner(s) is to a value at least 10% greater than that of the wild-type IgSF domain control and in some embodiments, at least 20%, 30%, 40%, 50%, 100%, 200%, 300%, 500%, 1000%, 5000%, or 10000% greater than that of the wild-type IgSF domain control value. A decrease in a protein's binding affinity or avidity to at least one of its cognate binding partner is to a value no greater than 90% of the control but no less than 10% of the wild-type IgSF domain control value, and in some embodiments no greater than 80%, 70% 60%, 50%, 40%, 30%, or 20% but no less than 10% of the wild-type IgSF domain control value. An affinity-modified protein is altered in primary amino acid sequence by substitution, addition, or deletion of amino acid residues. The term "affinity modified IgSF domain" is not be construed as imposing any condition for any particular starting composition or method by which the affinity-modified IgSF domain was created. Thus, the affinity modified IgSF domains of the present invention are not limited to wild type IgSF domains that are then transformed to an affinity modified IgSF domain by any particular process of affinity modification. An affinity modified IgSF domain polypeptide can, for example, be generated starting from wild type mammalian IgSF domain sequence information, then modeled in silico for binding to its cognate binding partner, and finally recombinantly or chemically synthesized to yield the affinity modified IgSF domain composition of matter. In but one alternative example, an affinity modified IgSF domain can be created by site-directed mutagenesis of a wild-type IgSF domain. Thus, affinity modified IgSF domain denotes a product and not necessarily a product produced by any given process. A variety of techniques including recombinant methods, chemical synthesis, or combinations thereof, may be employed.

The term "allogeneic" as used herein means a cell or tissue that is removed from one organism and then infused or adoptively transferred into a genetically dissimilar organism of the same species. In some embodiments of the invention, the species is murine or human.

The term "autologous" as used herein means a cell or tissue that is removed from the same organism to which it is later infused or adoptively transferred. An autologous cell or tissue can be altered by, for example, recombinant DNA methodologies, such that it is no longer genetically identical to the native cell or native tissue which is removed from the organism. For example, a native autologous T-cell can be genetically engineered by recombinant DNA techniques to become an autologous engineered cell expressing a transmembrane immunomodulatory protein and/or chimeric antigen receptor (CAR), which in some cases involves engineering a T-cell or TIL (tumor infiltrating lymphocyte). The engineered cells are then infused into a patient from which the native T-cell was isolated. In some embodiments, the organism is human or murine.

The terms "binding affinity," and "binding avidity" as used herein means the specific binding affinity and specific binding avidity, respectively, of a protein for its counter-structure under specific binding conditions. In biochemical kinetics avidity refers to the accumulated strength of multiple affinities of individual non-covalent binding interactions, such as between ICOSL and its counter-structures ICOS and/or CD28. As such, avidity is distinct from affinity, which describes the strength of a single interaction. An increase or attenuation in binding affinity of a variant ICOSL containing an affinity modified ICOSL IgSF domain to its counter-structure is determined relative to the binding affinity of the unmodified ICOSL, such as an unmodified ICOSL containing the native or wild-type IgSF domain, such as IgV domain. Methods for determining binding affinity or avidity are known in art. See, for example, Larsen et al., American Journal of Transplantation, Vol 5: 443-453 (2005). In some embodiments, a variant ICOSL of the invention (i.e. a ICOSL protein containing an affinity modified IgSF domain) specifically binds to CD28 and/or ICOS measured by flow cytometry with a binding affinity that yields a Mean Fluorescence Intensity (MFI) value at least 10%, 20%, 30%, 40%, 50%, 60%, 70%, 80%, 90%, or 100% greater than a wild-type ICOSL control in a binding assay such as described in Example 6.

The term "biological half-life" refers to the amount of time it takes for a substance, such as an immunomodulatory polypeptide comprising a variant ICOSL of the present invention, to lose half of its pharmacologic or physiologic activity or concentration. Biological half-life can be affected by elimination, excretion, degradation (e.g., enzymatic) of the substance, or absorption and concentration in certain organs or tissues of the body. In some embodiments, biological half-life can be assessed by determining the time it takes for the blood plasma concentration of the substance to reach half its steady state level ("plasma half-life"). Conjugates that can be used to derivatize and increase the biological half-life of polypeptides of the invention are known in the art and include, but are not limited to, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), polyglutamic acid (glutamylation).

The term "chimeric antigen receptor" or "CAR" as used herein refers to an artificial (i.e., man-made) transmembrane protein expressed on a mammalian cell comprising at least an ectodomain, a transmembrane, and an endodomain. Optionally, the CAR protein includes a "spacer" which covalently links the ectodomain to the transmembrane domain. A spacer is often a polypeptide linking the ectodomain to the transmembrane domain via peptide bonds. The CAR is typically expressed on a mammalian lymphocyte. In some embodiments, the CAR is expressed on a mammalian cell such as a T-cell or a tumor infiltrating lymphocyte (TIL). A CAR expressed on a T-cell is referred to herein as a "CAR T-cell" or "CAR-T." In some embodiments the CAR-T is a T helper cell, a cytotoxic T-cell, a natural killer T-cell, a memory T-cell, a regulatory T-cell, or a gamma delta T-cell. When used clinically in, e.g. adoptive cell transfer, a CAR-T with antigen binding specificity to the patient's tumor is typically engineered to express on a native T-cell obtained from the patient. The engineered T-cell expressing the CAR is then infused back into the patient. The CAR-T is thus often an autologous CAR-T although allogeneic CAR-T are included within the scope of the invention. The ectodomain of a CAR comprises an antigen binding region, such as an antibody or antigen binding fragment thereof (e.g. scFv), that specifically binds under physiological conditions with a target antigen, such as a tumor specific antigen. Upon specific binding a biochemical chain of events (i.e., signal transduction) results in modulation of the immunological activity of the CAR-T. Thus, for example, upon specific binding by the antigen binding region of the CAR-T to its target antigen can lead to changes in the immunological activity of the T-cell activity as reflected by changes in cytotoxicity, proliferation or cytokine production. Signal transduction upon CAR-T activation is achieved in some embodiments by the CD3-zeta chain ("CD3-z") which is involved in signal transduction in native mammalian T-cells. CAR-Ts can further comprise multiple signaling domains such as CD28, 41BB or OX40, to further modulate immunomodulatory response of the T-cell. CD3-z comprises a conserved motif known as an immunoreceptor tyrosine-based activation motif (ITAM) which is involved in T-cell receptor signal transduction.

The term "collectively" or "collective" when used in reference to cytokine production induced by the presence of two or more variant ICOSL of the invention in an in vitro assay, means the overall cytokine expression level irrespective of the cytokine production induced by individual variant ICOSL. In some embodiments, the cytokine being assayed is IFN-gamma in an in vitro primary T-cell assay such as described in Example 6 and Example 7.

The term "cognate binding partner" (used interchangeably with "counter-structure") in reference to a polypeptide, such as in reference to an IgSF domain of a variant ICOSL, refers to at least one molecule (typically a native mammalian protein) to which the referenced polypeptide specifically binds under specific binding conditions. In some aspects, a variant ICOSL containing an affinity modified IgSF domain specifically binds to the counter-structure of the corresponding native or wild-type ICOSL but with increased or attenuated affinity. A species of ligand recognized and specifically binding to its cognate receptor under specific binding conditions is an example of a counter-structure or cognate binding partner of that receptor. A "cognate cell surface binding partner" is a cognate binding partner expressed on a mammalian cell surface. A "cell surface molecular species" is a cognate binding partner of ligands of the immunological synapse (IS), expressed on and by cells, such as mammalian cells, forming the immunological synapse.

As used herein, "conjugate," "conjugation" or grammatical variations thereof refers the joining or linking together of two or more compounds resulting in the formation of another compound, by any joining or linking methods known in the art. It can also refer to a compound which is generated by the joining or linking together two or more compounds. For example, a variant ICOSL polypeptide linked directly or indirectly to one or more chemical moieties or polypeptide is an exemplary conjugate. Such conjugates include fusion proteins, those produced by chemical conjugates and those produced by any other methods.

The term "competitive binding" as used herein means that a protein is capable of specifically binding to at least two cognate binding partners but that specific binding of one cognate binding partner inhibits, such as prevents or precludes, simultaneous binding of the second cognate binding partner. Thus, in some cases, it is not possible for a protein to bind the two cognate binding partners at the same time. Generally, competitive binders contain the same or overlapping binding site for specific binding but this is not a requirement. In some embodiments, competitive binding causes a measurable inhibition (partial or complete) of specific binding of a protein to one of its cognate binding partner due to specific binding of a second cognate binding partner. A variety of methods are known to quantify competitive binding such as ELISA (enzyme linked immunosorbent assay) assays.

The term "conservative amino acid substitution" as used herein means an amino acid substitution in which an amino acid residue is substituted by another amino acid residue having a side chain R group with similar chemical properties (e.g., charge or hydrophobicity). Examples of groups of amino acids that have side chains with similar chemical properties include 1) aliphatic side chains: glycine, alanine, valine, leucine, and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartic acid and glutamic acid; and 7) sulfur-containing side chains: cysteine and methionine. Conservative amino acids substitution groups are: valine-leucine-isoleucine, phenylalanine-tyrosine, lysine-arginine, alanine-valine, glutamate-aspartate, and asparagine-glutamine.

The term, "corresponding to" with reference to positions of a protein, such as recitation that nucleotides or amino acid positions "correspond to" nucleotides or amino acid positions in a disclosed sequence, such as set forth in the Sequence listing, refers to nucleotides or amino acid positions identified upon alignment with the disclosed sequence based on structural sequence alignment or using a standard alignment algorithm, such as the GAP algorithm. For example, corresponding residues can be determined by alignment of a reference sequence with the sequence set forth in SEQ ID NO: 32 (ECD domain) or set forth in SEQ ID NOs: 196 or 545 (IgV domain) by structural alignment methods as described herein. By aligning the sequences, one skilled in the art can identify corresponding residues, for example, using conserved and identical amino acid residues as guides.

The terms "decrease" or "attenuate" "or suppress" as used herein means to decrease by a statistically significant amount. A decrease can be at least 10%, 20%, 30%, 40%, 50%, 60%, 70%, 80%, 90%, or 100% of a control value, such as a non-zero control value.

The terms "decreased" or "reduced" as used herein in the context of decreasing immunological activity of a mammalian lymphocyte means to decrease one or more activities of the lymphocyte, as compared to a control, such as an untreated control or a control in which a treatment using an unmodified or non-variant control was employed under the same conditions. A decreased activity can refer to one or more of cell cycle inhibition, reduced cell survival, reduced cell proliferation, reduced cytokine production, or reduced T-cell cytotoxicity, such as by a statistically significant amount. In some embodiments, reference to reduced immunological activity means to reduce interferon gamma (IFN-gamma) production compared to in the absence of treatment, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be a decrease by at least 5%10%, 15%, 20%, 25%, 30%, 35%, 40%, 45%, 50%, 60%, 70%, 80%, 90%, or 100%, as compared to a control value, such as an untreated control value or a non-zero control value.

The terms "derivatives" or "derivatized" refer to modification of a protein by covalently linking it, directly or indirectly, to a composition so as to alter such characteristics as biological half-life, bioavailability, immunogenicity, solubility, toxicity, potency, or efficacy while retaining or enhancing its therapeutic benefit. Derivatives of immunomodulatory polypeptides of the invention are within the scope of the invention and can be made by, for example, glycosylation, pegylation, lipidation, or Fc-fusion.

As used herein, domain (typically a sequence of three or more, generally 5 or 7 or more amino acids, such as 10 to 200 amino acid residues) refers to a portion of a molecule, such as a protein or encoding nucleic acid, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as binding activity. A protein can have one, or more than one, distinct domains. For example, a domain can be identified, defined or distinguished by homology of the primary sequence or structure to related family members, such as homology to motifs. In another example, a domain can be distinguished by its function, such as an ability to interact with a biomolecule, such as a cognate binding partner. A domain independently can exhibit a biological function or activity such that the domain independently or fused to another molecule can perform an activity, such as, for example binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

The term "ectodomain" as used herein refers to the region of a membrane protein, such as a transmembrane protein, that lies outside the vesicular membrane. Ectodomains often comprise binding domains that specifically bind to ligands or cell surface receptors, such as via a binding domain that specifically binds to the ligand or cell surface receptor. The ectodomain of a cellular transmembrane protein is alternately referred to as an extracellular domain.

The terms "effective amount" or "therapeutically effective amount" refer to a quantity and/or concentration of a therapeutic composition of the invention, including a protein composition or cell composition, that when administered ex vivo (by contact with a cell from a patient) or in vivo (by administration into a patient) either alone (i.e., as a monotherapy) or in combination with additional therapeutic agents, yields a statistically significant decrease in disease progression as, for example, by ameliorating or eliminating symptoms and/or the cause of the disease. An effective amount may be an amount that relieves, lessens, or alleviates at least one symptom or biological response or effect associated with a disease or disorder, prevents progression of the disease or disorder, or improves physical functioning of the patient. In the case of cell therapy, the effective amount is an effective dose or number of cells administered to a patient by adoptive cell therapy. In some embodiments the patient is a mammal such as a non-human primate or human patient.

The term "endodomain" as used herein refers to the region found in some membrane proteins, such as transmembrane proteins, that extends into the interior space defined by the cell surface membrane. In mammalian cells, the endodomain is the cytoplasmic region of the membrane protein. In cells, the endodomain interacts with intracellular constituents and can be play a role in signal transduction and thus, in some cases, can be an intracellular signaling domain. The endodomain of a cellular transmembrane protein is alternately referred to as a cytoplasmic domain, which, in some cases, can be a cytoplasmic signaling domain.

The terms "enhanced" or "increased" as used herein in the context of increasing immunological activity of a mammalian lymphocyte means to increase one or more activities the lymphocyte, as compared to a control, such as an untreated control or a control in which a treatment using an unmodified or non-variant control was employed under the same conditions. An increased activity can be one or more of increase cell survival, cell proliferation, cytokine production, or T-cell cytotoxicity, such as by a statistically significant amount. In some embodiments, reference to increased immunological activity means to increase interferon gamma (IFN-gamma) production, such as by a statistically significant amount. In some embodiments, the immunological activity can be assessed in a mixed lymphocyte reaction (MLR) assay. Methods of conducting MLR assays are known in the art. Wang et al., Cancer Immunol Res. 2014 September: 2(9):846-56. Other methods of assessing activities of lymphocytes are known in the art, including any assay as described herein. In some embodiments an enhancement can be an increase of at least 10%, 20%, 30%, 40%, 50%, 75%, 100%, 200%, 300%, 400%, or 500% greater than a non-zero control value.

The term "engineered cell" as used herein refers to a mammalian cell that has been genetically modified by human intervention such as by recombinant DNA methods or viral transduction. In some embodiments, the cell is an immune cell, such as a lymphocyte (e.g. T cell, B cell, NK cell) or an antigen presenting cell (e.g. dendritic cell). The cell can be a primary cell from a patient or can be a cell line. In some embodiments, an engineered cell of the invention comprises a variant ICOSL provided herein. In some embodiments, the variant ICOSL is a transmembrane immunomodulatory protein (hereinafter referred to as "TIP") that is expressed on the engineered cell. In some embodiments, the TIP contains the extracellular domain or a portion thereof containing the IgV domain linked to a transmembrane domain (e.g., a ICOSL transmembrane domain) and, optionally, an intracellular signaling domain. In some cases, the TIP is formatted as a chimeric receptor containing a heterologous cytoplasmic signaling domain or endodomain. In some embodiments, an engineered cell is capable of expressing and secreting a immunomodulatory protein as described herein. Among provided engineered cells also are cells further containing an engineered T-cell receptor (TCR) or chimeric antigen receptor (CAR).

The term "engineered T-cell" as used herein refers to a T-cell such as a T helper cell, cytotoxic T-cell (alternatively, cytotoxic T lymphocyte or CTL), natural killer T-cell, regulatory T-cell, memory T-cell, or gamma delta T-cell, that has been genetically modified by human intervention such as by recombinant DNA methods or viral transduction methods. An engineered T-cell comprises a variant ICOSL transmembrane immunomodulatory protein (TIP) or secreted immunomodulatory protein (SIP) of the present invention that is expressed on the T-cell and is engineered to modulate immunological activity of the engineered T-cell itself, or a mammalian cell to which the variant ICOSL expressed on the T-cell specifically binds. An engineered T-cell can comprise a variant ICOSL secreted immunomodulatory protein (SIP) of the present invention that is expressed by and/or secreted by the T-cell and is engineered to modulate immunological activity of the engineered T-cell itself, or a mammalian cell to which the variant ICOSL when secreted by the T-cell, specifically binds.

The term "engineered T-cell receptor" or "engineered TCR" refers to a T-cell receptor (TCR) engineered to specifically bind with a desired affinity to a major histocompatibility complex (MHC)/peptide target antigen that is selected, cloned, and/or subsequently introduced into a population of T-cells, often used for adoptive immunotherapy. In contrast to engineered TCRs, CARs are engineered to bind target antigens in a MHC independent manner.

The term "expressed on" as used herein is used in reference to a protein expressed on the surface of a cell, such as a mammalian cell. Thus, the protein is expressed as a membrane protein. In some embodiments, the expressed protein is a transmembrane protein. In some embodiments, the protein is conjugated to a small molecule moiety such as a drug or detectable label. Proteins expressed on the surface of a cell can include cell-surface proteins such as cell surface receptors that are expressed on mammalian cells.

The term "half-life extending moiety" refers to a moiety of a polypeptide fusion or chemical conjugate that extends the half-life of a protein circulating in mammalian blood serum compared to the half-life of the protein that is not so conjugated to the moiety. In some embodiments, half-life is extended by greater than or greater than about 1.2-fold, 1.5-fold, 2.0-fold, 3.0-fold, 4.0-fold, 5.0-fold, or 6.0-fold. In some embodiments, half-life is extended by more than 6 hours, more than 12 hours, more than 24 hours, more than 48 hours, more than 72 hours, more than 96 hours or more than 1 week after in vivo administration compared to the protein without the half-life extending moiety. The half-life refers to the amount of time it takes for the protein to lose half of its concentration, amount, or activity. Half-life can be determined for example, by using an ELISA assay or an activity assay. Exemplary half-life extending moieties include an Fc domain, a multimerization domain, polyethylene glycol (PEG), hydroxyethyl starch (HES), XTEN (extended recombinant peptides; see, WO2013130683), human serum albumin (HSA), bovine serum albumin (BSA), lipids (acylation), and poly-Pro-Ala-Ser (PAS), and polyglutamic acid (glutamylation).

The term "immunological synapse" or "immune synapse" as used herein means the interface between a mammalian cell that expresses MHC I (major histocompatibility complex) or MHC II, such as an antigen-presenting cell or tumor cell, and a mammalian lymphocyte such as an effector T cell or Natural Killer (NK) cell.

An Fc (fragment crystallizable) region or domain of an immunoglobulin molecule (also termed an Fc polypeptide) corresponds largely to the constant region of the immunoglobulin heavy chain, and is responsible for various functions, including the antibody's effector function(s). The Fc domain contains part or all of a hinge domain of an immunoglobulin molecule plus a CH2 and a CH3 domain. The Fc domain can form a dimer of two polypeptide chains joined by one or more disulfide bonds. In some embodiments, the Fc is a variant Fc that exhibits reduced (e.g. reduced greater than 30%, 40%, 50%, 60%, 70%, 80%, 90% or more) activity to facilitate an effector function. In some embodiments, reference to amino acid substitutions in an Fc region is by EU numbering system unless described with reference to a specific SEQ ID NO. EU numbering is known and is according to the most recently updated IMGT Scientific Chart (IMGT®, the international ImMunoGeneTics Information System® http://www.imgt.org/IMGTScientific-Chart/Numbering/Hu_IGHGnber.html (created: 17 May 2001, last updated: 10 Jan. 2013) and the EU index as reported in Kabat, E. A. et al. Sequences of Proteins of Immunological interest. 5th ed. US Department of Health and Human Services, NIH publication No. 91-3242 (1991).

An immunoglobulin Fc fusion ("Fc-fusion"), such as an immunomodulatory Fc fusion protein, is a molecule comprising one or more polypeptides (or one or more small molecules) operably linked to an Fc region of an immunoglobulin. An Fc-fusion may comprise, for example, the Fc region of an antibody (which facilitates effector functions and pharmacokinetics) and a variant ICOSL. An immunoglobulin Fc region may be linked indirectly or directly to one or more variant ICOSL or small molecules (fusion partners).

Various linkers are known in the art and can optionally be used to link an Fc to a fusion partner to generate an Fc-fusion. Fc-fusions of identical species can be dimerized to form Fc-fusion homodimers, or using non-identical species to form Fc-fusion heterodimers. In some embodiments, the Fc is a mammalian Fc such as a murine or human Fc.

The term "host cell" refers to a cell that can be used to express a protein encoded by a recombinant expression vector. A host cell can be a prokaryote, for example, *E. coli*, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include Chinese hamster ovary (CHO) cells or their derivatives such as Veggie CHO and related cell lines which grow in serum-free media or CHO strain DX-B11, which is deficient in DHFR. In some embodiments, a host cell is a mammalian cell (e.g., a human cell, a monkey cell, a hamster cell, a rat cell, a mouse cell, or an insect cell).

The term "immunoglobulin" (abbreviated "Ig") as used herein refers to a mammalian immunoglobulin protein including any of the five human classes of antibody: IgA (which includes subclasses IgA1 and IgA2), IgD, IgE, IgG (which includes subclasses IgG1, IgG2, IgG3, and IgG4), and IgM. The term is also inclusive of immunoglobulins that are less than full-length, whether wholly or partially synthetic (e.g., recombinant or chemical synthesis) or naturally produced, such as antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)$_2$, F(ab')$_2$, dsFv diabody, Fc, and Fd polypeptide fragments. Bispecific antibodies, homobispecific and heterobispecific, are included within the meaning of the term.

The term "immunoglobulin superfamily" or "IgSF" as used herein means the group of cell surface and soluble proteins that are involved in the recognition, binding, or adhesion processes of cells. Molecules are categorized as members of this superfamily based on shared structural features with immunoglobulins (i.e., antibodies); they all possess a domain known as an immunoglobulin domain or fold. Members of the IgSF include cell surface antigen receptors, co-receptors and co-stimulatory molecules of the immune system, molecules involved in antigen presentation to lymphocytes, cell adhesion molecules, certain cytokine receptors and intracellular muscle proteins. They are commonly associated with roles in the immune system. Proteins in the immunological synapse are often members of the IgSF. IgSF can also be classified into "subfamilies" based on shared properties such as function. Such subfamilies typically consist of from 4 to 30 IgSF members.

The terms "IgSF domain" or "immunoglobulin domain" or "Ig domain" as used herein refers to a structural domain of IgSF proteins. Ig domains are named after the immunoglobulin molecules. They contain about 70-110 amino acids and are categorized according to their size and function. Ig-domains possess a characteristic Ig-fold, which has a sandwich-like structure formed by two sheets of antiparallel beta strands. Interactions between hydrophobic amino acids on the inner side of the sandwich and highly conserved disulfide bonds formed between cysteine residues in the B and F strands, stabilize the Ig-fold. One end of the Ig domain has a section called the complementarity determining region that is important for the specificity of antibodies for their ligands. The Ig like domains can be classified (into classes) as: IgV, IgC1, IgC2, or IgI. Most Ig domains are either variable (IgV) or constant (IgC). IgV domains with 9 beta strands are generally longer than IgC domains with 7 beta strands. Ig domains of some members of the IgSF resemble IgV domains in the amino acid sequence, yet are similar in size to IgC domains. These are called IgC2 domains, while standard IgC domains are called IgC1 domains. T-cell receptor (TCR) chains contain two Ig domains in the extracellular portion; one IgV domain at the N-terminus and one IgC1 domain adjacent to the cell membrane. ICOSL contains two Ig domains: IgV and IgC.

The term "IgSF species" as used herein means an ensemble of IgSF member proteins with identical or substantially identical primary amino acid sequence. Each mammalian immunoglobulin superfamily (IgSF) member defines a unique identity of all IgSF species that belong to that IgSF member. Thus, each IgSF family member is unique from other IgSF family members and, accordingly, each species of a particular IgSF family member is unique from the species of another IgSF family member. Nevertheless, variation between molecules that are of the same IgSF species may occur owing to differences in post-translational modification such as glycosylation, phosphorylation, ubiquitination, nitrosylation, methylation, acetylation, and lipidation. Additionally, minor sequence differences within a single IgSF species owing to gene polymorphisms constitute another form of variation within a single IgSF species as do wild type truncated forms of IgSF species owing to, for example, proteolytic cleavage. A "cell surface IgSF species" is an IgSF species expressed on the surface of a cell, generally a mammalian cell.

The term "immunological activity" as used herein in the context of mammalian lymphocytes such as T-cells refers to one or more cell survival, cell proliferation, cytokine production (e.g. interferon-gamma), or T-cell cytotoxicity activities. In some cases, an immunological activity can mean the cell expression of cytokines, such as chemokines or interleukins. Assays for determining enhancement or suppression of immunological activity include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104). Since T cell activation is associated with secretion of IFN-gamma cytokine, detecting IFN-gamma levels in culture supernatants from these in vitro human T cell assays can be assayed using commercial ELISA kits (Wu et al, Immunol Lett 2008 Apr. 15; 117(1): 57-62). Induction of an immune response results in an increase in immunological activity relative to quiescent lymphocytes. An immunomodulatory protein, such as a variant ICOSL polypeptide containing an affinity modified IgSF domain, as provided herein can in some embodiments increase or, in alternative embodiments, decrease IFN-gamma (interferon-gamma) expression in a primary T-cell assay relative to a wild-type IgSF member or IgSF domain control. Those of skill will recognize that the format of the primary T-cell assay used to determine an increase in IFN-gamma expression will differ from that employed to assay for a decrease in IFN-gamma expression. In assaying for the ability of an immunomodulatory protein or affinity modified IgSF domain of the invention to decrease IFN-gamma expression in a primary T-cell assay, a Mixed Lymphocyte Reaction (MLR) assay can be used as described in Example 6. Conveniently, a soluble form of an affinity modified IgSF domain of the invention can be employed to determine its ability to antagonize and thereby decrease the IFN-gamma expression in a MLR as likewise described in Example 6. Alternatively, in assaying for the ability of an immunomodulatory protein or affinity modified IgSF domain of the invention to increase IFN-gamma expression in a primary T-cell assay, a co-immobilization assay can be used. In a co-immobilization assay, a T-cell receptor signal, provided in some embodiments by anti-CD3 antibody, is used in conjunction with a co-immobilized affinity modified IgSF domain, such as variant ICOSL, to determine the ability to increase IFN-gamma expression relative to a wild-type IgSF domain control. Methods to assay the immunological activity of engineered cells, including to evaluate the activity of a variant ICOSL transmembrane immunomodulatory protein, are known in the art and include, but are not limited to, the ability to expand T cells following antigen stimulation, sustain T cell expansion in the absence of re-stimulation, and anti-cancer activities in appropriate animal models. Assays also include assays to assess cytotoxicity, including a standard $^{51}$Cr-release assay (see e.g. Milone et al., (2009) Molecular Therapy 17: 1453-1464) or flow based cytotoxicity assays, or an impedance based cytotoxicity assay (Peper et al. (2014) Journal of Immunological Methods, 405:192-198).

An "immunomodulatory polypeptide" or "immunomodulatory protein" is a polypeptide or protein molecule that modulates immunological activity. By "modulation" or "modulating" an immune response is meant that immunological activity is either increased or decreased. An immunomodulatory protein can be a single polypeptide chain or a multimer (dimers or higher order multimers) of at least two polypeptide chains covalently bonded to each other by, for example, interchain disulfide bonds. Thus, monomeric, dimeric, and higher order multimeric polypeptides are within the scope of the defined term. Multimeric polypeptides can be homomultimeric (of identical polypeptide chains) or heteromultimeric (of non-identical polypeptide chains). An immunomodulatory protein of the invention comprises a variant ICOSL.

The term "increase" as used herein means to increase by a statistically significant amount. An increase can be at least 5%, 10%, 20%, 30%, 40%, 50%, 75%, 100%, or greater than a non-zero control value.

An "isoform" of ICOSL (inducible costimulator ligand; CD275) is one of a plurality of naturally occurring ICOSL polypeptides that differ in amino acid sequence. Isoforms can be the product of splice variants of an RNA transcript expressed by a single gene, or the expression product of highly similar but different genes yielding a functionally similar protein such as may occur from gene duplication. As used herein, the term "isoform" of ICOSL also refers to the product of different alleles of an ICOSL gene (e.g., ICOSLG).

The term "lymphocyte" as used herein means any of three subtypes of white blood cell in a mammalian immune system. They include natural killer cells (NK cells) (which function in cell-mediated, cytotoxic innate immunity), T cells (for cell-mediated, cytotoxic adaptive immunity), and B cells (for humoral, antibody-driven adaptive immunity). T cells include: T helper cells, cytotoxic T-cells, natural killer T-cells, memory T-cells, regulatory T-cells, or gamma delta T-cells. Innate lymphoid cells (ILC) are also included within the definition of lymphocyte.

The terms "mammal," or "patient" specifically includes reference to at least one of a: human, chimpanzee, rhesus monkey, cynomolgus monkey, dog, cat, mouse, or rat.

The term "membrane protein" as used herein means a protein that, under physiological conditions, is attached directly or indirectly to a lipid bilayer. A lipid bilayer that forms a membrane can be a biological membrane such as a eukaryotic (e.g., mammalian) cell membrane or an artificial (i.e., man-made) membrane such as that found on a liposome. Attachment of a membrane protein to the lipid bilayer can be by way of covalent attachment, or by way of non-covalent interactions such as hydrophobic or electrostatic interactions. A membrane protein can be an integral membrane protein or a peripheral membrane protein. Membrane proteins that are peripheral membrane proteins are non-covalently attached to the lipid bilayer or non-covalently attached to an integral membrane protein. A peripheral membrane protein forms a temporary attachment to the lipid bilayer such that under the range of conditions that are physiological in a mammal, peripheral membrane protein can associate and/or disassociate from the lipid bilayer. In contrast to peripheral membrane proteins, integral membrane proteins form a substantially permanent attachment to the membrane's lipid bilayer such that under the range of conditions that are physiological in a mammal, integral membrane proteins do not disassociate from their attachment to the lipid bilayer. A membrane protein can form an attachment to the membrane by way of one layer of the lipid bilayer (monotopic), or attached by way of both layers of the membrane (polytopic). An integral membrane protein that interacts with only one lipid bilayer is an "integral monotopic protein". An integral membrane protein that interacts with both lipid bilayers is an "integral polytopic protein" alternatively referred to herein as a "transmembrane protein".

The terms "modulating" or "modulate" as used herein in the context of an immune response, such as a mammalian immune response, refer to any alteration, such as an increase or a decrease, of existing or potential immune responses that occurs as a result of administration of an immunomodulatory polypeptide comprising a variant ICOSL of the present invention or as a result of administration of engineered cells expresses an immunomodulatory protein, such as a variant ICOSL transmembrane immunomodulatory protein of the present invention. Thus, it refers to an alteration, such as an increase or decrease, of an immune response as compared to the immune response that occurs or is present in the absence of the administration of the immunomodulatory protein comprising the variant ICOSL or cells expressing such an immunomodulatory polypeptide. Such modulation includes any induction, activation, suppression or alteration in degree or extent of immunological activity of an immune cell. Immune cells include B cells, T cells, NK (natural killer) cells, NK T cells, professional antigen-presenting cells (APCs), and non-professional antigen-presenting cells, and inflammatory cells (neutrophils, macrophages, monocytes, eosinophils, and basophils). Modulation includes any change imparted on an existing immune response, a developing immune response, a potential immune response, or the capacity to induce, regulate, influence, or respond to an immune response. Modulation includes any alteration in the expression and/or function of genes, proteins and/or other molecules in immune cells as part of an immune response. Modulation of an immune response or modulation of immunological activity includes, for example, the following: elimination, deletion, or sequestration of immune cells; induction or generation of immune cells that can modulate the functional capacity of other cells such as autoreactive lymphocytes, antigen presenting cells, or inflammatory cells; induction of an unresponsive state in immune cells (i.e., anergy); enhancing or suppressing the activity or function of immune cells, including but not limited to altering the pattern of proteins expressed by these cells. Examples include altered production and/or secretion of certain classes of molecules such as cytokines, chemokines, growth factors, transcription factors, kinases, costimulatory molecules, or other cell surface receptors or any combination of these modulatory events. Modulation can be assessed, for example, by an alteration in IFN-gamma (interferon gamma) expression relative to the wild-type ICOSL control in a primary T cell assay (see, Zhao and Ji, Exp Cell Res. 2016 Jan. 1; 340(1) 132-138). Modulation can be assessed, for example, by an alteration of an immunological activity of engineered cells, such as an alteration in in cytotoxic activity of engineered cells or an alteration in cytokine secretion of engineered cells relative to cells engineered with a wild-type ICOSL transmembrane protein.

The term "molecular species" as used herein means an ensemble of proteins with identical or substantially identical primary amino acid sequence. Each mammalian immunoglobulin superfamily (IgSF) member defines a collection of identical or substantially identical molecular species. Thus, for example, human ICOSL is an IgSF member and each human ICOSL molecule is a molecular species of ICOS. Variation between molecules that are of the same molecular species may occur owing to differences in post-translational modification such as glycosylation, phosphorylation, ubiquitination, nitrosylation, methylation, acetylation, and lipidation. Additionally, minor sequence differences within a single molecular species owing to gene polymorphisms constitute another form of variation within a single molecular species as do wild type truncated forms of a single molecular species owing to, for example, proteolytic cleavage. A "cell surface molecular species" is a molecular species expressed on the surface of a mammalian cell. Two or more different species of protein, each of which is present exclusively on one or exclusively the other (but not both) of the two mammalian cells forming the IS, are said to be in "cis" or "cis configuration" with each other. Two different species of protein, the first of which is exclusively present on one of the two mammalian cells forming the IS and the second of which is present exclusively on the second of the two mammalian cells forming the IS, are said to be in "trans" or "trans configuration." Two different species of protein each of which is present on both of the two mammalian cells forming the IS are in both cis and trans configurations on these cells.

The term, a "multimerization domain" refers to a sequence of amino acids that promotes stable interaction of a polypeptide molecule with one or more additional polypeptide molecules, each containing a complementary multimerization domain (e.g. a first multimerization domain and a second multimerization domain), which can be the same or a different multimerization domain. The interactions between complementary multimerization domains, e.g. interaction between a first multimerization domain and a second multimerization domain, form a stable protein-protein interaction to produce a multimer of the polypeptide molecule with the additional polypeptide molecule. In some cases, the multimerization domain is the same and interacts with itself to form a stable protein-protein interaction between two polypeptide chains. Generally, a polypeptide is joined directly or indirectly to the multimerization domain. Exemplary multimerization domains include the immunoglobulin sequences or portions thereof, leucine zippers, hydrophobic regions, hydrophilic regions, and compatible protein-protein interaction domains. The multimerization domain, for example, can be an immunoglobulin constant region or domain, such as, for example, the Fc domain or portions thereof from IgG, including IgG1, IgG2, IgG3 or IgG4 subtypes, IgA, IgE, IgD and IgM and modified forms thereof.

The terms "nucleic acid" and "polynucleotide" are used interchangeably to refer to a polymer of nucleic acid residues (e.g., deoxyribonucleotides or ribonucleotides) in either single- or double-stranded form. Unless specifically limited, the terms encompass nucleic acids containing known analogues of natural nucleotides and that have similar binding properties to it and are metabolized in a manner similar to naturally-occurring nucleotides. Unless otherwise indicated, a particular nucleic acid sequence also implicitly encompasses conservatively modified variants thereof (e.g., degenerate codon substitutions) and complementary nucleotide sequences as well as the sequence explicitly indicated (a "reference sequence"). Specifically, degenerate codon substitutions may be achieved by generating sequences in which the third position of one or more selected (or all) codons is substituted with mixed-base and/or deoxyinosine residues. The term nucleic acid or polynucleotide encompasses cDNA or mRNA encoded by a gene.

The term "non-competitive binding" as used herein means the ability of a protein to specifically bind simultaneously to at least two cognate binding partners. Thus, the protein is able to bind to at least two different cognate binding partners at the same time, although the binding interaction need not be for the same duration such that, in some cases, the protein is specifically bound to only one of the cognate binding partners. In some embodiments, the binding occurs under specific binding conditions. In some embodiments, the simultaneous binding is such that binding of one cognate binding partner does not substantially inhibit simultaneous binding to a second cognate binding partner. In some embodiments, non-competitive binding means that binding a second cognate binding partner to its binding site on the protein does not displace the binding of a first cognate binding partner to its binding site on the protein. Methods of assessing non-competitive binding are well known in the art such as the method described in Perez de La Lastra et al., Immunology, 1999 April: 96(4): 663-670. In some cases, in non-competitive interactions, the first cognate binding partner specifically binds at an interaction site that does not overlap with the interaction site of the second cognate binding partner such that binding of the second cognate binding partner does not directly interfere with the binding of the first cognate binding partner. Thus, any effect on binding of the cognate binding partner by the binding of the second cognate binding partner is through a mechanism other than direct interference with the binding of the first cognate binding partner. For example, in the context of enzyme-substrate interactions, a non-competitive inhibitor binds to a site other than the active site of the enzyme. Non-competitive binding encompasses uncompetitive binding interactions in which a second cognate binding partner specifically binds at an interaction site that does not overlap with the binding of the first cognate binding partner but binds to the second interaction site only when the first interaction site is occupied by the first cognate binding partner.

The term "pharmaceutical composition" refers to a composition suitable for pharmaceutical use in a mammalian subject, often a human. A pharmaceutical composition typically comprises an effective amount of an active agent (e.g., an immunomodulatory polypeptide comprising a variant ICOSL or engineered cells expressing a variant ICOSL transmembrane immunomodulatory protein) and a carrier, excipient, or diluent. The carrier, excipient, or diluent is typically a pharmaceutically acceptable carrier, excipient or diluent, respectively.

The terms "polypeptide" and "protein" are used interchangeably herein and refer to a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. The terms also include molecules in which one or more amino acid analogs or non-canonical or unnatural amino acids are included as can be synthesized, or expressed recombinantly using known protein engineering techniques. In addition, proteins can be derivatized.

The term "primary T-cell assay" as used herein refers to an in vitro assay to measure interferon-gamma ("IFN-gamma") expression. A variety of such primary T-cell assays are known in the art such as that described in Example 7. In a preferred embodiment, the assay used is an anti-CD3 coimmobilizaton assay. In this assay, primary T cells are stimulated by anti-CD3 immobilized with or without additional recombinant proteins. Culture supernatants are harvested at timepoints, usually 24-72 hours. In another embodiment, the assay used is the MLR. In this assay, primary T cells are stimulated with allogeneic APC. Culture supernatants are harvested at timepoints, usually 24-72 hours. Human IFN-gamma levels are measured in culture supernatants by standard ELISA techniques. Commercial kits are available from vendors and the assay is performed according to manufacturer's recommendation.

The term "purified" as applied to nucleic acids, such as encoding immunomodulatory proteins of the invention, generally denotes a nucleic acid or polypeptide that is substantially free from other components as determined by analytical techniques well known in the art (e.g., a purified polypeptide or polynucleotide forms a discrete band in an electrophoretic gel, chromatographic eluate, and/or a media subjected to density gradient centrifugation). For example, a nucleic acid or polypeptide that gives rise to essentially one band in an electrophoretic gel is "purified." A purified nucleic acid or protein of the invention is at least about 50% pure, usually at least about 75%, 80%, 85%, 90%, 95%, 96%, 99% or more pure (e.g., percent by weight or on a molar basis).

The term "recombinant" indicates that the material (e.g., a nucleic acid or a polypeptide) has been artificially (i.e., non-naturally) altered by human intervention. The alteration can be performed on the material within, or removed from, its natural environment or state. For example, a "recombinant nucleic acid" is one that is made by recombining nucleic acids, e.g., during cloning, affinity modification, DNA shuffling or other well-known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid or that is otherwise altered by genetic engineering, such as by introducing into the cell a nucleic acid molecule encoding a recombinant protein, such as a transmembrane immunomodulatory protein provided herein. Transcriptional control signals in eukaryotes comprise "promoter" and "enhancer" elements. Promoters and enhancers consist of short arrays of DNA sequences that interact specifically with cellular proteins involved in transcription. Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. The terms "in operable combination," "in operable order" and "operably linked" as used herein refer to the linkage of nucleic acid sequences in such a manner or orientation that a nucleic acid molecule capable of directing the transcription of a given gene and/or the synthesis of a desired protein molecule is produced.

The term "recombinant expression vector" as used herein refers to a DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the recombinant expression vector, operably linked to the coding sequence for the recombinant protein, such as a recombinant fusion protein, so that the expressed fusion protein can be secreted by the recombinant host cell, for easier isolation of the fusion protein from the cell, if desired. The term includes the vector as a self-replicating nucleic acid structure as well as the vector incorporated into the genome of a host cell into which it has been introduced. Among the vectors are viral vectors, such as lentiviral vectors.

The term "selectivity" refers to the preference of a subject protein, or polypeptide, for specific binding of one substrate, such as one cognate binding partner, compared to specific binding for another substrate, such as a different cognate binding partner of the subject protein. Selectivity can be reflected as a ratio of the binding activity (e.g. binding affinity) of a subject protein and a first substrate, such as a first cognate binding partner, (e.g., $K_{d1}$) and the binding activity (e.g. binding affinity) of the same subject protein with a second cognate binding partner (e.g., $K_{d2}$).

The term "sequence identity" as used herein refers to the sequence identity between genes or proteins at the nucleotide or amino acid level, respectively. "Sequence identity" is a measure of identity between proteins at the amino acid level and a measure of identity between nucleic acids at nucleotide level. The protein sequence identity may be determined by comparing the amino acid sequence in a given position in each sequence when the sequences are aligned. Similarly, the nucleic acid sequence identity may be determined by comparing the nucleotide sequence in a given position in each sequence when the sequences are aligned. Methods for the alignment of sequences for comparison are well known in the art, such methods include GAP, BESTFIT, BLAST, FASTA and TFASTA. The BLAST algorithm calculates percent sequence identity and performs a statistical analysis of the similarity between the two sequences. The software for performing BLAST analysis is publicly available through the National Center for Biotechnology Information (NCBI) website.

The term "soluble" as used herein in reference to proteins, means that the protein is not a membrane protein. In general, a soluble protein contains only the extracellular domain of an IgSF family member receptor, or a portion thereof containing an IgSF domain or domains or specific-binding fragments thereof, but does not contain the transmembrane domain and/or is not capable of being expressed on the surface of a cell. In some cases, solubility of a protein can be improved by linkage or attachment, directly or indirectly via a linker, to an Fc domain, which, in some cases, also can improve the stability and/or half-life of the protein. In some aspects, a soluble protein is an Fc fusion protein.

The term "species" as used herein with respect to polypeptides or nucleic acids means an ensemble of molecules with identical or substantially identical sequences. Variation between polypeptides that are of the same species may occur owing to differences in post-translational modification such as glycosylation, phosphorylation, ubiquitination, nitrosylation, methylation, acetylation, and lipidation. Slightly truncated sequences of polypeptides that differ (or encode a difference) from the full length species at the amino-terminus or carboxy-terminus by no more than 1, 2, or 3 amino acid residues are considered to be of a single species. Such microheterogeneities are a common feature of manufactured proteins.

The term "specific binding fragment" as used herein in reference to a full-length wild-type mammalian ICOSL polypeptide or an IgV or an IgC domain thereof, means a polypeptide having a subsequence of an IgV and/or IgC domain and that specifically binds in vitro and/or in vivo to a mammalian ICOS and/or mammalian CD28 such as a human or murine ICOS or CD28. In some embodiments, the specific binding fragment of ICOSL IgV or ICOSL IgC is at least 60%, 70%, 75%, 80%, 85%, 90%, 95%, 96%, 97%, 98%, or 99% the sequence length of the full-length wild-type sequence. The specific binding fragment can be altered in sequence to form a variant ICOSL of the invention.

The term "specifically binds" as used herein means the ability of a protein, under specific binding conditions, to bind to a target protein such that its affinity or avidity is at least 5 times as great, but optionally at least 10, 20, 30, 40, 50, 100, 250 or 500 times as great, or even at least 1000 times as great as the average affinity or avidity of the same protein to a collection of random peptides or polypeptides of sufficient statistical size. A specifically binding protein need not bind exclusively to a single target molecule but may specifically bind to a non-target molecule due to similarity in structural conformation between the target and non-target (e.g., paralogs or orthologs). Those of skill will recognize that specific binding to a molecule having the same function in a different species of animal (i.e., ortholog) or to a non-target molecule having a substantially similar epitope as the target molecule (e.g., paralog) is possible and does not detract from the specificity of binding which is determined relative to a statistically valid collection of unique non-targets (e.g., random polypeptides). Thus, a polypeptide of the invention may specifically bind to more than one distinct species of target molecule due to cross-reactivity. Solid-phase ELISA immunoassays or Biacore measurements can be used to determine specific binding between two proteins. Generally, interactions between two binding proteins have dissociation constants ($K_d$) less than $1\times10^{-5}$ M, and often as low as $1\times10^{-12}$ M. In certain embodiments of the present disclosure, interactions between two binding proteins have dissociation constants of $1\times10^{-6}$ M, $1\times10^{-7}$ M, $1\times10^{-8}$ M, $1\times10^{-9}$ M, $1\times10^{-10}$ M or $1\times10^{-11}$ M.

The terms "surface expresses", "surface expression" or "expressed on the surface" in reference to a mammalian cell expressing a polypeptide means that the polypeptide is expressed as a membrane protein. In some embodiments, the membrane protein is a transmembrane protein.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

The term "targeting moiety" as used herein refers to a composition that is covalently or non-covalently attached to, or physically encapsulates, a polypeptide comprising a variant ICOSL of the present invention. In some embodiments, the targeting moiety has specific binding affinity for a target molecule such as a target molecule expressed on a cell. Typically, the target molecule is localized on a specific tissue or cell-type. Targeting moieties include: antibodies, antigen binding fragment (Fab), variable fragment (Fv) containing $V_H$ and $V_L$, the single chain variable fragment (scFv) containing $V_H$ and $V_L$ linked together in one chain, as well as other antibody V region fragments, such as Fab', F(ab)$_2$, F(ab')$_2$, dsFv diabody, nanobodies, soluble receptors, receptor ligands, affinity matured receptors or ligands, as well as small molecule (<500 dalton) compositions (e.g., specific binding receptor compositions). Targeting moieties can also be attached covalently or non-covalently to the lipid membrane of liposomes that encapsulate a polypeptide of the present invention.

The term "transmembrane protein" as used herein means a membrane protein that substantially or completely spans a lipid bilayer such as those lipid bilayers found in a biological membrane such as a mammalian cell, or in an artificial construct such as a liposome. The transmembrane protein comprises a transmembrane domain ("transmembrane domain") by which it is integrated into the lipid bilayer and by which the integration is thermodynamically stable under physiological conditions. Transmembrane domains are generally predictable from their amino acid sequence via any number of commercially available bioinformatics software applications on the basis of their elevated hydrophobicity relative to regions of the protein that interact with aqueous environments (e.g., cytosol, extracellular fluid). A transmembrane domain is often a hydrophobic alpha helix that spans the membrane. A transmembrane protein can pass through the both layers of the lipid bilayer once or multiple times. A transmembrane protein includes the provided transmembrane immunomodulatory proteins described herein. In addition to the transmembrane domain, a transmembrane immunomodulatory protein of the invention further comprises an ectodomain and, in some embodiments, an endodomain.

The terms "treating," "treatment," or "therapy" of a disease or disorder as used herein mean slowing, stopping or reversing the disease or disorders progression, as evidenced by decreasing, cessation or elimination of either clinical or diagnostic symptoms, by administration of a therapeutic composition (e.g. containing an immunomodulatory protein or engineered cells) of the invention either alone or in combination with another compound as described herein. "Treating," "treatment," or "therapy" also means a decrease in the severity of symptoms in an acute or chronic disease or disorder or a decrease in the relapse rate as for example in the case of a relapsing or remitting autoimmune disease course or a decrease in inflammation in the case of an inflammatory aspect of an autoimmune disease. As used herein in the context of cancer, the terms "treatment" or, "inhibit," "inhibiting" or "inhibition" of cancer refers to at least one of: a statistically significant decrease in the rate of tumor growth, a cessation of tumor growth, or a reduction in the size, mass, metabolic activity, or volume of the tumor, as measured by standard criteria such as, but not limited to, the Response Evaluation Criteria for Solid Tumors (RECIST), or a statistically significant increase in progression free survival (PFS) or overall survival (OS). "Preventing," "prophylaxis," or "prevention" of a disease or disorder as used in the context of this invention refers to the administration of an immunomodulatory polypeptide or engineered cells of the invention, either alone or in combination with another compound, to prevent the occurrence or onset of a disease or disorder or some or all of the symptoms of a disease or disorder or to lessen the likelihood of the onset of a disease or disorder.

The term "tumor specific antigen" or "TSA" as used herein refers to a counter-structure that is present primarily on tumor cells of a mammalian subject but generally not found on normal cells of the mammalian subject. A tumor specific antigen need not be exclusive to tumor cells but the percentage of cells of a particular mammal that have the tumor specific antigen is sufficiently high or the levels of the tumor specific antigen on the surface of the tumor are sufficiently high such that it can be targeted by anti-tumor therapeutics, such as immunomodulatory polypeptides of the invention, and provide prevention or treatment of the mammal from the effects of the tumor. In some embodiments, in a random statistical sample of cells from a mammal with a tumor, at least 50% of the cells displaying a TSA are cancerous. In other embodiments, at least 60%, 70%, 80%, 85%, 90%, 95%, or 99% of the cells displaying a TSA are cancerous.

The term "variant" (also "modified" or mutant") as used in reference to a variant ICOSL means an ICOSL, such as a mammalian (e.g., human or murine) ICOSL created by human intervention. The variant ICOSL is a polypeptide having an altered amino acid sequence, relative to a reference (e.g. unmodified) or wild-type ICOSL. The variant ICOSL is a polypeptide which differs from a reference ICOSL, such as a wild-type ICOSL isoform sequence, by one or more modifications, such as one or more amino acid substitutions, deletions, additions, or combinations thereof. For purposes herein, the variant ICOSL contains at least one affinity modified domain, whereby one or more of the amino acid differences occurs in an IgSF domain (e.g. IgV domain). A variant ICOSL can contain 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid differences, such as amino acid substitutions. A variant ICOSL polypeptide generally exhibits at least 50%, 60%, 70%, 80%, 85%, 86%, 87%, 88%, 89%9, 90%, 91%, 92%, 93%, 94%, 95%, 96%, 97%, 98%, 99% or more sequence identity to a corresponding reference (e.g. unmodified ICOSL) or wild-type, such as to the sequence of SEQ ID NO:5, a mature sequence thereof or a portion thereof containing the extracellular domain or an IgSF domain thereof. In some embodiments, a variant ICOSL polypeptide exhibits at least 50%, 60%, 70%, 80%, 85%, 86%, 87%, 88%, 89%, 90%, 91%, 92%, 93%, 94%, 95%, 96%, 97%, 98%, 99% or more sequence identity to a corresponding reference (e.g. unmodified) or wild-type ICOSL, such as a reference ICOSL set forth in SEQ ID NO:32 or SEQ ID NOs: 196 or 545. Non-naturally occurring amino acids as well as naturally occurring amino acids are included within the scope of permissible substitutions or additions. A variant ICOSL is not limited to any particular method of making and includes, for example, de novo chemical synthesis, de novo recombinant DNA techniques, or combinations thereof. A variant ICOSL of the invention specifically binds to CD28, ICOS, and/or CTLA-4 of a mammalian species. In some embodiments, the altered amino acid sequence results in an altered (i.e., increased or decreased) binding affinity or avidity to ICOS and/or CD28 compared to the reference (e.g. unmodified) or wild-type ICOSL protein. An increase or decrease in binding affinity or avidity can be determined using well known binding assays such as flow cytometry. Larsen et al., American Journal of Transplantation, Vol 5: 443-453 (2005). See also, Linsley et al., Immunity, Vol. 1(9): 793-801 (1994). An increase in variant ICOSL binding affinity or avidity to ICOS and/or CD28 is to a value at least 5% greater than that of the reference (e.g. unmodified) or wild-type ICOSL and in some embodiments, at least 10%, 15%, 20%, 30%, 40%, 50%, 100% greater than that of the reference (e.g. unmodified) or wild-type ICOSL control value. A decrease in ICOSL binding affinity or avidity to ICOS and/or CD28 is to a value no greater than 95% of the of the wild-type control values, and in some embodiments no greater than 80%, 70% 60%, 50%, 40%, 30%, 20%, 10%, 5%, or no detectable binding affinity or avidity of the wild-type ICOS and/or CD28 control values. A variant ICOSL is altered in primary amino acid sequence by substitution, addition, or deletion of amino acid residues. The term "variant" in the context of variant ICOSL is not be construed as imposing any condition for any particular starting composition or method by which the variant ICOSL is created. A variant ICOSL can, for example, be generated starting from a reference ICOSL or wild type mammalian ICOSL sequence information, then modeled in silico for binding to ICOS and/or CD28, and finally recombinantly or chemically synthesized to yield a variant ICOSL of the present invention. In but one alternative example, a variant ICOSL can be created by site-directed mutagenesis of a reference (e.g. unmodified) or wild-type ICOSL. Thus, variant ICOSL denotes a composition and not necessarily a product produced by any given process. A variety of techniques including recombinant methods, chemical synthesis, or combinations thereof, may be employed.

The term "wild-type" or "natural" or "native" as used herein is used in connection with biological materials such as nucleic acid molecules, proteins (e.g., ICOSL), IgSF members, host cells, and the like, refers to those which are found in nature and not modified by human intervention.

II. VARIANT ICOSL POLYPEPTIDES

Provided herein are variant ICOSL polypeptides that exhibit altered (increased or decreased) binding activity or affinity for one or more of an ICOSL cognate binding partner. In some embodiments, the ICOSL cognate binding partner is one or more of CD28, ICOS, or CTLA-4. In some embodiments, the variant ICOSL polypeptide contains one or more amino acids modifications, such as one or more substitutions (alternatively, "mutations" or "replacements"), deletions or addition, in an immunoglobulin superfamily (IgSF) domain (IgD) relative to a wild-type or unmodified ICOSL polypeptide or a portion of a wild-type or unmodified ICOSL containing an immunoglobulin superfamily (IgSF) domain or a specific binding fragment thereof. Thus, a provided variant ICOSL polypeptide is or comprises a variant IgD (hereinafter called "vIgD") in which the one or more amino acid modifications (e.g. substitutions) is in an IgD.

In some embodiments, the IgD comprises an IgV domain or an IgC (e.g. IgC2) domain or specific binding fragment of the IgV domain or the IgC (e.g. IgC2) domain, or combinations thereof. In some embodiments, the IgD can be an IgV only, the combination of the IgV and IgC, including the entire extracellular domain (ECD), or any combination of Ig domains of ICOSL. Table 2 provides exemplary residues that correspond to IgV or IgC regions of ICOSL. In some embodiments, the variant ICOSL polypeptide contains an IgV domain or an IgC domain or specific binding fragments thereof in which the at least one of the amino acid modifications (e.g. substitutions) is in the IgV domain or IgC domain or a specific binding fragment thereof. In some embodiments, by virtue of the altered binding activity or affinity, the IgV domain or IgC domain is an affinity-modified IgSF domain.

In some embodiments, the variant is modified in one more IgSF domains relative to the sequence of a reference (e.g., unmodified) ICOSL sequence. In some embodiments, the reference (e.g., unmodified) ICOSL sequence is a wild-type ICOSL. In some embodiments, the reference (e.g., unmodified) or wild-type ICOSL has the sequence of a native ICOSL or an ortholog thereof. In some embodiments, the reference (e.g., unmodified) or wild-type ICOSL is or comprises the extracellular domain (ECD) of ICOSL or a portion thereof containing one or more IgSF domain (see Table 2). In some embodiments, the extracellular domain of a reference (e.g., unmodified) or wild-type ICOSL polypeptide comprises an IgV domain and an IgC domain or domains. However, the variant ICOSL polypeptide need not comprise both the IgV domain and the IgC domain or domains. In some embodiments, the variant ICOSL polypeptide comprises or consists essentially of the IgV domain or a specific binding fragment thereof. In some embodiments, the variant ICOSL polypeptide comprises or consists essentially of the IgC domain or specific binding fragments thereof. In some embodiments, the variant ICOSL is soluble and lacks a transmembrane domain. In some embodiments, the variant ICOSL further comprises a transmembrane domain and, in some cases, also a cytoplasmic domain.

In some embodiments, the reference (e.g., unmodified) or wild-type ICOSL sequence is a mammalian ICOSL sequence. In some embodiments, the reference (e.g., unmodified) or wild-type ICOSL sequence can be a mammalian ICOSL that includes, but is not limited to, human, mouse, cynomolgus monkey, or rat. In some embodiments, the reference (e.g., unmodified) or wildtype ICOSL sequence is human.

In some embodiments, the reference (e.g., unmodified) or wild-type ICOSL sequence has (i) the sequence of amino acids set forth in SEQ ID NO:5 or a mature form thereof lacking the signal sequence, (ii) a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:5 or the mature form thereof, or (iii) is a portion of (i) or (ii) containing an IgV domain or IgC domain or specific binding fragments thereof.

In some embodiments, the reference ICOSL sequence is or comprises an extracellular domain of the ICOSL or a portion thereof. In some embodiments, the reference or wild-type ICOSL polypeptide comprises the amino acid sequence set forth in SEQ ID NO:32, or an ortholog thereof.

(SEQ ID NO: 32)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

-continued
RPNVYWINKTDNSLLDQALQNDTVFLNMRGLYDVVSVLRIARTPSVNIG

CCIENVLLQQNLTVGSQTGNDIGERDKITENPVSTGEKNAAT

In some cases, the reference (e.g., unmodified) or wild-type ICOSL polypeptide can comprise (i) the sequence of amino acids set forth in SEQ ID NO:32, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 32, or (iii) is a specific binding fragment of the sequence of (i) or (ii) comprising an IgV domain or an IgC domain.

In some embodiments, the reference ICOSL polypeptide comprises a truncated extracellular domain comprising a C-terminal truncation with reference to the reference ICOSL extracellular domain sequence set forth in SEQ ID NO:32. In some embodiments, the C-terminal truncation is of at least 10, at least 20, at least 30, at least 40, at least 50, at least 60, at least 70, at least 80, at least 90, at least 100, at least 125 amino acid residues. In some embodiments, the C-terminal truncation is of at least 1, at least 5 at least 10, at least 15, at least 20, at least 25, at least 30, at least 35 amino acid residues. In some embodiments, the ICOSL polypeptide comprising a C-terminal truncation does not contain, beyond the C-terminus of the truncation point, contiguous amino acid residues of a wild-type ICOSL. Hence, among provided ICOSL reference sequences are those that are shorter than the full extracellular domain of a wild-type ICOSL, e.g. set forth in SEQ ID NO: 32. In some embodiments, the ICOSL polypeptide comprising a C-terminal truncation does not contain or is not fused to amino acid residues of an ICOSL domain beyond the extracellular domain.

In some embodiments, the ICOSL reference polypeptide is altered, such as mutated or deleted, in one or more protease cleavage site. As found herein, wild-type ICOSL polypeptide contains a protease cleavage site that, in some cases, results in cleavage of the protein upon expression in cells, e.g. Chinese Hamster Ovary cells, thereby resulting in a heterogeneous product of multiple species, including species of different lengths or sizes. For example, cleavage of the ICOSL polypeptide may occur at the LQQN/LT protease cleavage site between residues 207 and 208 of SEQ ID NO: 32 ("/" indicates potential cleavage site). In some embodiments, the ICOSL reference polypeptide is altered in or lacks a protease cleavage site set forth as amino acids 204-209 of SEQ ID NO:32. In some embodiments, a truncated ICOSL polypeptide is more resistant to protease cleavage compared to a wild-type or non-truncated ICOSL polypeptide. Exemplary truncated ICOSL polypeptide ECD truncations lacking all or a portion of the LQQN/LT protease cleavage site (designated Truncations #2, #3, #4, #5, #6, #7, or #8) are provided in SEQ ID NOs: 600-606.

Truncation #2:
(SEQ ID NO: 600)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLLQQNL

Truncation #3:
(SEQ ID NO: 601)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLLQQNLTVGSQ

Truncation #4:
(SEQ ID NO: 602)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLLQQN

Truncation #5:
(SEQ ID NO: 603)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLLQQ

Truncation #6:
(SEQ ID NO: 604)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLL

Truncation #7:
(SEQ ID NO: 605)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIEN

Truncation #8:
(SEQ ID NO: 606)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLLQQNLT

In some embodiments, the ICOSL reference polypeptide is altered in one or more amino acids corresponding to amino acids 204-209 with reference to SEQ ID NO:32. In some embodiments, the variant ICOSL polypeptide has one or more amino acid modification, e.g., substitution in a reference ICOSL or specific binding fragment thereof corresponding to position(s) 207 and/or 208 with reference to numbering of SEQ ID NO:32. In some embodiments, the variant ICOSL polypeptide has one or more amino acid modification, e.g., substitution, selected from N207A, N207G, L208G, or a conservative amino acid modification, e.g., substitution thereof. In some embodiments, the one or more amino acid modification, e.g., substitution is N207A/L208G or N207G/L208G. In some embodiments, the full length reference ECDs or truncated reference ECDs of the variant ICOSL polypeptide are modified to contain one or more amino acid modifications, e.g., substitutions, selected from N207A, N207G, L208G, or a conservative amino acid modification. Exemplary full length or truncated reference ECDs with one or more modifications are set forth in SEQ ID NOs: 607-628. Exemplary reference sequences containing mutations at cleavage site N207 and/or L208 with reference to positions are set forth in SEQ ID NO: 32 are set forth in SEQ ID NOs: 624-628. In some cases, the provided modifications may reduce protease cleavage of the ICOSL polypeptide, such as cleavage that may occur at the LQQN/LT protease cleavage site.

In some embodiments, combinations of the above truncation and modification strategies can be employed in a reference ICOSL ECD sequence. In some embodiments, the modifications e.g., substitutions, are made in a truncated reference ICOSL polypeptide such as exemplary reference ICOSL sequence set forth in SEQ ID NOs: 600-606. Exemplary variant ICOSL polypeptide sequences with modifications at the potential protease cleavage site(s) N207 and/or L208 are set forth in SEQ ID NOs: 607-628. In some embodiments, the variant ICOSL polypeptide exhibits decreased protease cleavage compared to wild-type ICOSL polypeptide, such as containing the ECD sequence set forth in SEQ ID NO:32.

In some embodiments, the reference (e.g., unmodified) or wildtype ICOSL polypeptide comprises an IgV domain or an IgC domain, or a specific binding fragment thereof. In some embodiments, an ICOSL reference polypeptide containing an IgV domain comprises the amino acid sequence set forth in SEQ ID NO: 196 (corresponding to amino acid residues 19-129 of SEQ ID NO:5), or an ortholog thereof.

(SEQ ID NO: 196)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVE

In some embodiments, the reference ICOSL polypeptide containing the IgV domain contains at least amino acids 1-112, 1-113, 1-114, 1-115, 1-116, 1-117, 1-118, 1-119, 1-120, 1-121, 1-122, with reference to numbering set forth in SEQ ID NO:32. In some embodiments, an ICOSL reference polypeptide containing an IgV domain comprises the amino acid sequence set forth in SEQ ID NO: 545 (corresponding to amino acid residues 19-140 of SEQ ID NO:5), or an ortholog thereof. In some embodiments, the IgV domain is the only IgSF domain of the ICOSL reference polypeptide.

(SEQ ID NO: 545)
DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSV

In some embodiments, the IgV domain of the reference (e.g., unmodified) or wild-type ICOSL polypeptide can contain (i) the sequence of amino acids set forth in SEQ ID NO: 196 or 545, (ii) a sequence of amino acids that has at least about 85%, 86%, 87%, 88%, 89%, 90%, 91%, 92%, 93%, 94%, 95%, 96%, 97%, 98%, 99% sequence identity to SEQ ID NO: 196 or 545, or (iii) a specific binding fragment of the sequence of amino acids set forth in SEQ ID NO: 196 or 545 or a specific binding fragment of a sequence of (i) or (ii). In some embodiments, the reference (e.g., unmodified) IgV domain is capable of binding one or more ICOSL cognate binding proteins, such as one or more of CD28, ICOS, or CTLA-4.

In some embodiments, the IgC domain of the reference (e.g., unmodified) or wild-type ICOSL polypeptide comprises the amino acid sequence set forth as residues 141-227 of SEQ ID NO: 5, or an ortholog thereof. For example, the IgC domain of the reference (e.g., unmodified) or wild-type ICOSL polypeptide can contain (i) the sequence of amino acids set forth residues 141-227 of SEQ ID NO: 5, (ii) a sequence of amino acids that has at least about 85%, 86%, 87%, 88%, 89%, 90%, 91%, 92%, 93%, 94%, 95%, 96%, 97%, 98%, 99% sequence identity to residues 141-227 of SEQ ID NO: 5, or (iii) (i) or (ii). In some embodiments, the reference IgV domain is capable of binding one or more ICOSL cognate binding proteins.

In some embodiments, the reference (e.g., unmodified) or wild-type ICOSL polypeptide contains a specific binding fragment of ICOSL, such as a specific binding fragment of the IgV domain or the IgC domain. In some embodiments the specific binding fragment can bind CD28, ICOS, and/or CTLA-4. The specific binding fragment can have an amino acid length of at least 50 amino acids, such as at least 60, 70, 80, 90, 100, or 110 amino acids. In some embodiments, the specific binding fragment of the IgV domain contains an amino acid sequence that is at least about 85%, 86%, 87%, 88%, 89%, 90%, 91%, 92%, 93%, 94%, 95%, 96%, 97%, 98%, 99% of the length of the IgV domain set forth as amino acids 19-129 of SEQ ID NO: 5. In some embodiments, the specific binding fragment of the IgC domain comprises an amino acid sequence that is at least about 85%, 86%, 87%, 88%, 89%, 90%, 91%, 92%, 93%, 94%, 95%, 96%, 97%, 98%, 99% of the length of the IgC domain set forth as amino acids 141-227 of SEQ ID NO: 5.

In some embodiments, the variant ICOSL polypeptide comprises the ECD domain, a truncated ECD domain, or a portion thereof comprising one or more affinity modified IgSF domains. In some embodiments, the variant ICOSL polypeptides can comprise an IgV domain or an IgC domain, in which one or more of the IgSF domains (IgV or IgC) or a specific binding fragment of the IgV domain or a specific binding fragment of the IgC domain contains the one or more amino acid modifications (e.g. substitutions). In some embodiments, the variant ICOSL polypeptides can comprise an IgV domain and an IgC domain, or a specific binding fragment of the IgV domain and a specific binding fragment of the IgC domain. In some embodiments, the variant ICOSL polypeptide comprises a full-length IgV domain. In some embodiments, the variant ICOSL polypeptide comprises a full-length IgC domain. In some embodiments, the variant ICOSL polypeptide comprises a specific binding fragment of the IgV domain. In some embodiments, the variant ICOSL polypeptide comprises a specific binding fragment of the IgC domain. In some embodiments, the variant ICOSL polypeptide comprises a full-length IgV domain and a full-length IgC domain. In some embodiments, the variant ICOSL polypeptide comprises a full-length IgV domain and a specific binding fragment of an IgC domain. In some embodiments, the variant ICOSL polypeptide comprises a specific binding fragment of an IgV domain and a full-length IgC domain. In some embodiments, the variant ICOSL polypeptide comprises a specific binding fragment of an IgV domain and a specific binding fragment of an IgC domain.

In any of such embodiments, the one or more amino acid modifications (e.g., substitutions) of the variant ICOSL polypeptides can be located in any one or more of the ICOSL polypeptide domains. For example, in some embodiments, one or more amino acid substitutions are located in the extracellular domain (ECD) of the variant ICOSL polypeptide, such as set forth in SEQ ID NO: 32. In some embodiments, one or more amino acid substitutions are located in the IgV domain or specific binding fragment of the IgV domain. In some embodiments, one or more amino acid modifications (e.g. substitutions) are located in the IgC domain or specific binding fragment of the IgC domain.

Generally, each of the various attributes of polypeptides are separately disclosed below (e.g., soluble, secretable and membrane bound polypeptides, affinity of ICOSL for CD28, ICOS, and CTLA-4, number of variations per polypeptide chain, number of linked polypeptide chains, the number and nature of amino acid alterations per variant ICOSL, etc.). However, as will be clear to the skilled artisan, any particular polypeptide can comprise a combination of these independent attributes. It is understood that reference to amino acids, including to a specific sequence set forth as a SEQ ID NO used to describe domain organization of an IgSF domain are for illustrative purposes and are not meant to limit the scope of the embodiments provided. It is understood that polypeptides and the description of domains thereof are theoretically derived based on homology analysis and alignments with similar molecules. Thus, the exact locus can vary, and is not necessarily the same for each protein. Hence, the specific IgSF domain, such as specific IgV domain or IgC domain, can be several amino acids (such as one, two, three or four) longer or shorter.

Further, various embodiments of the invention as discussed below are frequently provided within the meaning of a defined term as disclosed above. The embodiments described in a particular definition are therefore to be interpreted as being incorporated by reference when the defined term is utilized in discussing the various aspects and attributes described herein. Thus, the headings, the order of presentation of the various aspects and embodiments, and the separate disclosure of each independent attribute is not meant to be a limitation to the scope of the present disclosure.

A. Exemplary Modifications

Provided herein are variant ICOSL polypeptides containing at least one affinity-modified IgSF domain (e.g., IgV or IgC) or a specific binding fragment thereof in an IgSF domain contained in a reference (e.g., unmodified) or wild-type ICOSL polypeptide such that the variant ICOSL polypeptide exhibits altered (increased or decreased) binding activity or affinity for one or more ligands ICOS, CD28, or CTLA-4 compared to a reference (e.g., unmodified) or wild-type ICOSL polypeptide. In some embodiments, a variant ICOSL polypeptide has a binding affinity for CD28, ICOS, and/or CTLA-4 that differs from that of a reference (e.g., unmodified) or wild-type ICOSL polypeptide control sequence as determined by, for example, solid-phase ELISA immunoassays, flow cytometry or Biacore assays. In some embodiments, the variant ICOSL polypeptide has an increased binding affinity for CD28, ICOS, and/or CTLA-4. In some embodiments, the variant ICOSL polypeptide has a decreased binding affinity for CD28, ICOS, and/or CTLA-4, relative to a reference (unmodified) or wild-type ICOSL polypeptide. The CD28, ICOS and/or the CTLA-4 can be a mammalian protein, such as a human protein or a murine protein.

Binding affinities for each of the cognate binding partners are independent; that is, in some embodiments, a variant ICOSL polypeptide has an increased binding affinity for one, two or three of CD28, ICOS, and/or CTLA-4, and a decreased binding affinity for one, two or three of CD28, ICOS, and CTLA-4, relative to a reference (e.g., unmodified) or wild-type ICOSL polypeptide.

In some embodiments, the variant ICOSL polypeptide has an increased binding affinity for CD28, relative to a reference (e.g., unmodified) or wildtype ICOSL polypeptide. In some embodiments, the variant ICOSL polypeptide has an increased binding affinity for ICOS, relative to a reference (e.g., unmodified) or wild-type ICOSL polypeptide. In some embodiments, the variant ICOSL polypeptide has an increased binding affinity for CTLA-4, relative to a reference (e.g., unmodified) or wild-type ICOSL polypeptide. In some embodiments, the variant ICOSL polypeptide has a decreased binding affinity for CD28, relative to a reference (e.g., unmodified) or wild-type ICOSL polypeptide. In some embodiments, the variant ICOSL polypeptide has a decreased binding affinity for ICOS, relative to a reference (e.g., unmodified) or wild-type ICOSL polypeptide. In some embodiments, the variant ICOSL polypeptide has a decreased binding affinity for CTLA-4, relative to a reference (e.g., unmodified) or wild-type ICOSL polypeptide.

In some embodiments, the variant ICOSL polypeptide has an increased binding affinity for CD28 and ICOS, relative to a reference (e.g., unmodified) or wild-type ICOSL polypeptide. In some embodiments, the variant ICOSL polypeptide has an increased binding affinity for CD28 and a decreased binding affinity for ICOS, relative to a reference (e.g., unmodified) or wild-type ICOSL polypeptide. In some embodiments, the variant ICOSL polypeptide has a decreased binding affinity for CD28 and ICOS, relative to a reference (e.g., unmodified) or wild-type ICOSL polypeptide. In some embodiments, the variant ICOSL polypeptide has a decreased binding affinity for CD28 and an increased binding affinity for ICOS, relative to a reference (e.g., unmodified) or wild-type ICOSL polypeptide.

In some embodiments, the variant ICOSL polypeptide has an increased binding affinity for CD28 and CTLA-4, relative to a reference (e.g., unmodified) or wild-type ICOSL polypeptide. In some embodiments, the variant ICOSL polypeptide has an increased binding affinity for CD28 and a decreased binding affinity for CTLA-4, relative to a reference (e.g., unmodified) or wild-type ICOSL polypeptide. In some embodiments, the variant ICOSL polypeptide has a decreased binding affinity for CD28 and CTLA-4, relative to a reference (e.g., unmodified) or wild-type ICOSL polypeptide. In some embodiments, the variant ICOSL polypeptide has a decreased binding affinity for CD28 and an increased binding affinity for CTLA-4, relative to a reference (e.g., unmodified) or wild-type ICOSL polypeptide.

In some embodiments, the variant ICOSL polypeptide has an increased binding affinity for ICOS and CTLA-4, relative to a reference (e.g., unmodified) or wild-type ICOS polypeptide. In some embodiments, the variant ICOSL polypeptide has an increased binding affinity for ICOS and a decreased binding affinity for CTLA-4, relative to a reference (e.g., unmodified) or wild-type ICOSL polypeptide. In some embodiments, the variant ICOSL polypeptide has a decreased binding affinity for ICOS and CTLA-4, relative to a reference (e.g., unmodified) or wild-type ICOSL polypeptide. In some embodiments, the variant ICOSL polypeptide has a decreased binding affinity for ICOS and an increased binding affinity for CTLA-4, relative to a reference (e.g., unmodified) or wild-type ICOSL polypeptide.

In some embodiments, the variant ICOSL polypeptide has an increased binding affinity for CD28, ICOS, and CTLA-4, relative to a reference (e.g., unmodified) or wild-type ICOSL polypeptide. In some embodiments, the variant ICOSL polypeptide has an increased binding affinity for CD28 and ICOS, and a decreased binding affinity for CTLA-4, relative to a reference (e.g., unmodified) or wild-type ICOSL polypeptide. In some embodiments, the variant ICOSL polypeptide has an increased binding affinity for CD28 and CTLA-4, and a decreased binding affinity for ICOS, relative to a reference (e.g., unmodified) or wild-type ICOSL polypeptide. In some embodiments, the variant ICOSL polypeptide has a decreased binding affinity for CD28 and ICOS, and an increased binding affinity for CTLA-4, relative to a reference (e.g., unmodified) or wild-type ICOSL polypeptide. In some embodiments, the variant ICOSL polypeptide has a decreased binding affinity for CD28 and an increased binding affinity for ICOS and CTLA-4, relative to a reference (e.g., unmodified) or wild-type ICOSL polypeptide. In some embodiments, the variant ICOSL polypeptide has an increased binding affinity for CD28, and a decreased binding affinity for ICOS and CTLA-4, relative to a reference (e.g., unmodified) or wild-type ICOSL polypeptide. In some embodiments, the variant ICOSL polypeptide has a decreased binding affinity for CD28, CTLA-4, and ICOS, relative to a reference (e.g., unmodified) or wild-type ICOSL polypeptide. In some embodiments, the variant ICOSL polypeptide has a decreased binding affinity for CD28, and an increased binding affinity for ICOS and CTLA-4, relative to a reference (e.g., unmodified) or wild-type ICOSL polypeptide.

In some embodiments, a variant ICOSL polypeptide with increased or greater binding affinity to CD28, ICOS, and/or CTLA-4 will have an increase in binding affinity relative to the reference (e.g., unmodified) or wild-type ICOSL polypeptide control of at least about 5%, such as at least about 10%, 15%, 20%, 25%, 35%, or 50% for the CD28, ICOS, and/or CTLA-4. In some embodiments, the increase in binding affinity relative to the reference (e.g., unmodified) or wild-type ICOSL polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the reference (e.g., unmodified) or wild-type ICOSL polypeptide has the same sequence as the variant ICOSL polypeptide except that it does not contain the one or more amino acid modifications (e.g., substitutions).

In some embodiments, a variant ICOSL polypeptide with reduced or decreased binding affinity to CD28, ICOS, and/or CTLA-4 will have decrease in binding affinity relative to the reference (e.g., unmodified) or wild-type ICOSL polypeptide control of at least 5%, such as at least about 10%, 15%, 20%, 30%, 40%, 50%, 60%, 70%, 80%, 90% or more for the CD28, ICOSL, and/or CTLA-4. In some embodiments, the decrease in binding affinity relative to the reference (e.g., unmodified) or wild-type ICOSL polypeptide is more than 1.2-fold, 1.5-fold, 2-fold, 3-fold, 4-fold, 5-fold, 6-fold, 7-fold, 8-fold, 9-fold, 10-fold, 20-fold, 30-fold 40-fold or 50-fold. In such examples, the reference (e.g., unmodified) or wild-type ICOSL polypeptide has the same sequence as the variant ICOSL polypeptide except that it does not contain the one or more amino acid modifications, e.g. substitutions.

In some embodiments, the equilibrium dissociation constant ($K_d$) of any of the foregoing embodiments to CD28, ICOS, and/or CTLA-4 can be less than $1\times10^{-5}$ M, $1\times10^{-6}$ M, $1\times10^{-7}$ M, $1\times10^{-8}$ M, $1\times10^{-9}$ M, $1\times10^{-10}$ M or $1\times10^{-11}$ M, or $1\times10^{-12}$ M.

In some embodiments, a variant ICOSL polypeptide has an increased or greater binding affinity to CD28. In some embodiments, a variant ICOSL polypeptide with increased or greater binding affinity to CD28 will have an increase in binding affinity relative to the reference (e.g., unmodified) or wild-type ICOSL polypeptide control of at least about 25%, such as at least about 30%, 40%, 50%, or 60% for CD28. In some embodiments, a variant ICOSL polypeptide with increased or greater binding affinity to CD28 has an equilibrium dissociation constant ($K_d$) of less than 200 pM, 300 pM, 400 pM, 500 pM, or 600 pM for CD28. In some embodiments, the variant polypeptide specifically binds to the ectodomain of one of ICOS, CD28 or CTLA4 with increased selectivity compared to the reference (e.g., unmodified) or wild-type ICOSL. In some embodiments, the increased selectivity is for CD28. In some embodiments, the increased selectivity comprises a greater ratio of binding of the variant ICOSL polypeptide for one cognate binding partner selected from among ICOS, CD28 and CTLA4 versus another of the cognate binding partner compared to the ratio of binding of the reference (e.g., unmodified) or wild-type ICOSL polypeptide for the one cognate binding partner versus the another of the cognate binding partner. In some embodiments, the ratio is greater by at least or at least about 1.5-fold, 2.0-fold, 3.0-fold, 4.0-fold, 5-fold, 10-fold, 15-fold, 20-fold, 30-fold, 40-fold, 50-fold or more.

The reference (e.g., unmodified) or wild-type ICOSL sequence does not necessarily have to be used as a starting composition to generate variant ICOSL polypeptides described herein. Therefore, use of the term "modification", such as "substitution" does not imply that the present embodiments are limited to a particular method of making variant ICOSL polypeptides. Variant ICOSL polypeptides can be made, for example, by de novo peptide synthesis and thus does not necessarily require a modification, such as a "substitution", in the sense of altering a codon to encode for the modification, e.g. substitution. This principle also extends to the terms "addition" and "deletion" of an amino acid residue which likewise do not imply a particular method of making. The means by which the variant ICOSL polypeptides are designed or created is not limited to any particular method. In some embodiments, however, a reference (e.g., unmodified) or wild-type ICOSL encoding nucleic acid is mutagenized from reference (e.g., unmodified) or wild-type ICOSL genetic material and screened for desired specific binding affinity and/or induction of IFN-gamma expression or other functional activity. In some embodiments, a variant ICOSL polypeptide is synthesized de novo utilizing protein or nucleic acid sequences available at any number of publicly available databases and then subsequently screened. The National Center for Biotechnology Information provides such information and its website is publicly accessible via the internet as is the UniProtKB database as discussed previously.

Unless stated otherwise, as indicated throughout the present disclosure, the amino acid modification (s) are designated by amino acid position number corresponding to the numbering of positions of the reference ECD sequence set forth in SEQ ID NO:32. It is within the level of a skilled artisan to identify the corresponding position of a modification, e.g. amino acid substitution, in an ICOSL polypeptide, including portion thereof containing an IgSF domain (e.g. IgV) thereof, such as by alignment of a reference sequence (e.g. SEQ ID NO:196, 545, 600-628) with SEQ ID NO:32. In the listing of modifications throughout this disclosure, the amino acid position is indicated in the middle, with the corresponding reference (e.g. unmodified or wild-type) amino acid listed before the number and the identified variant amino acid substitution listed after the number. If the modification is a deletion of the position a "del" is indicated and if the modification is an insertion at the position an "ins" is indicated. In some cases, an insertion is listed with the amino acid position indicated in the middle, with the corresponding reference amino acid listed before and after the number and the identified variant amino acid insertion listed after the unmodified (e.g. wild-type) amino acid.

In some embodiments, the variant ICOSL polypeptide has one or more amino acid modification, e.g. substitution in a reference (e.g., unmodified) or wild-type ICOSL sequence. The one or more amino acid modification, e.g. substitution, can be in the ectodomain (extracellular domain) of the reference (e.g., unmodified) or wild-type ICOSL sequence. In some embodiments, the one or more amino acid modification, e.g. substitution is in the IgV domain or specific binding fragment thereof. In some embodiments, the one or more amino acid modification, e.g. substitution is in the IgC domain or specific binding fragment thereof. In some embodiments of the variant ICOSL polypeptide, some of the one or more amino acid modification, e.g. substitution is in the IgV domain or a specific binding fragment thereof, and some of the one or more amino acid modification, e.g. substitution are in the IgC domain or a specific binding fragment thereof.

In some embodiments, the variant ICOSL polypeptide has up to 1, 2, 3, 4, 5, 6, 7, 8, 9, 10, 11, 12, 13, 14, 15, 16, 17, 18, 19, or 20 amino acid modification(s), e.g. substitution. The modification, e.g. substitution can be in the IgV domain or the IgC domain. In some embodiments, the variant ICOSL polypeptide has up to 1, 2, 3, 4, 5, 6, 7, 8, 9, 10, 11, 12, 13, 14, 15, 16, 17, 18, 19, or 20 amino acid substitutions in the IgV domain or specific binding fragment thereof. In some embodiments, the variant ICOSL polypeptide has up to 1, 2, 3, 4, 5, 6, 7, 8, 9, 10, 11, 12, 13, 14, 15, 16, 17, 18, 19, or 20 amino acid substitutions in the IgC domain or specific binding fragment thereof. In some embodiments, the variant ICOSL polypeptide has at least about 85%, 86%, 86%, 88%, 89%, 90%, 91%, 92%, 93%, 94%, 95%, 96%, 97%, 98%, or 99% sequence identity with the reference (e.g., unmodified) or wild-type ICOSL polypeptide or specific binding fragment thereof, such as with the amino acid sequence of SEQ ID NO: 32, 196 or 545.

In some embodiments, the variant ICOSL polypeptide has one or more amino acid modification, e.g. substitution in a reference ICOSL or specific binding fragment there of corresponding to position(s) 10, 11, 13, 16, 18, 20, 25, 27, 30, 33, 37, 42, 43, 47, 52, 54, 57, 61, 62, 67, 71, 72, 74, 77, 78, 75, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 138, 139, 140, 142, 143, 144, 146, 151, 152, 153, 154, 155, 156, 158, 161, 166, 168, 172, 173, 175, 190, 192, 193, 194, 198, 201, 203, 207, 208, 210, 212, 217, 218, 220, 221, 224, 225, or 227 with reference to numbering of SEQ ID NO:32. In some embodiments, the variant ICOSL polypeptide has one or more amino acid modification, e.g. substitution in a reference ICOSL or specific binding fragment there of corresponding to position(s) 10, 11, 13, 16, 18, 20, 25, 26, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 137, 138, 139, 140, 142, 143, 144, 146, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to numbering of SEQ ID NO:32.

In some embodiments, such variant ICOSL polypeptides exhibit altered binding affinity to one or more of CD28, ICOS, and/or CTLA-4 compared to the reference (e.g., unmodified) or wild-type ICOSL polypeptide. For example, in some embodiments, the variant ICOSL polypeptide exhibits increased binding affinity to CD28, ICOS, and/or CTLA-4 compared to a reference (e.g., unmodified) or wild-type ICOSL polypeptide. In some embodiments, the variant ICOSL polypeptide exhibits decreased binding affinity to CD28, ICOS, or CTLA-4 compared to a reference (e.g., unmodified) or wild-type ICOSL polypeptide.

In some embodiments, the variant ICOSL polypeptide has one or more amino acid modification, e.g. substitution selected from M10V, M10I, V11E, S13G, E16V, S18R, A20V, S25G, F27S, F27C, N30D, Y33del, Q37R, K42E, Y47H, T43A, N52A, N52C, N52D, N52G, N52H, N52L, N52K, N52M, N52P, N52Q, N52R, N52S, N52T, N52V, N52Y, S54A, S54P, N57A, N57E, N57F, N57H, N57K, N57L, N57M, N57P, N57Q, N57S, N57T, N57V, N57W, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100A, Q100D, Q100E, Q100G, Q100K, Q100L, Q100M, Q100N, Q100R, Q100P, Q100S, Q100T, Q100V, L102R, G103E, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, S142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T190S, T190A, S192G, V193M, N194D, C198R, N201S, L203P, L203F, N207Q, L208P, V210A, S212G, D217V, I218T, I218N, E220G, R221G, R221I, I224V, T225A, N227K or a conservative amino acid modification, e.g. substitution thereof. In some embodiments, the variant ICOSL polypeptide has one or more amino acid modification, e.g. substitution selected from M10V, M10I, V11E, S13G, E16V, S18R, A20V, A20T, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110A, V110D, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193A, V193M, N194D, C198R, N201S, L203F, L203P, N207Q, L208P, V210A, S212G, D217G, D217V, I218N, I218T, E220G, R221G, R221I, R221K, I224V, T225A, T225S, N227K, or a conservative amino acid substitution thereof.

R221I, R221K, I224V, T225A, T225S, N227K, or a conservative amino acid substitution thereof.

A conservative amino acid modification, e.g. substitution is any amino acid that falls in the same class of amino acids as the substituted amino acids, other than the reference (e.g., unmodified) or wild-type amino acid. The classes of amino acids are aliphatic (glycine, alanine, valine, leucine, and isoleucine), hydroxyl or sulfur-containing (serine, cysteine, threonine, and methionine), cyclic (proline), aromatic (phenylalanine, tyrosine, tryptophan), basic (histidine, lysine, and arginine), and acidic/amide (aspartate, glutamate, asparagine, and glutamine).

In some embodiments, the variant ICOSL polypeptide has one or more amino acid modification, e.g. substitution selected from M10V, M10I, V11E, S13G, E16V, S18R, A20V, S25G, F27S, F27C, N30D, Y33del, Q37R, K42E, T43A, Y47H, N52A, N52C, N52D, N52G, N52H, N52L, N52K, N52M, N52P, N52Q, N52R, N52S, N52T, N52V, N52Y, S54A, S54P, N57A, N57E, N57F, N57H, N57K, N57L, N57M, N57P, N57Q, N57S, N57T, N57V, N57W, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100A, Q100D, Q100E, Q100G, Q100K, Q100L, Q100M, Q100N, Q100R, Q100P, Q100S, Q100T, Q100V, G103E, L102R, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140D, C140del, S142F, I143V, I143T, N144D, Y146C, V151A, Y152C, Y152H, W153R, I154F, N155H, N155Q, K156M, D158G, L161P, L161M, L166Q, N168Q, F172S, L173S, M175T, T190A, T190S, S192G, V193M, N194D, C198R, N201S, L203P, L203F, N207Q, L208P, V210A, S212G, D217V, I218T, I218N, E220G, R221G, R221I, I224V, T225A, or N227K. In some embodiments, the variant ICOSL polypeptide has one or more amino acid modification, e.g. substitution selected from M10V, M10I, V11E, S13G, E16V, S18R, A20T, A20V, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110A, V110D, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193A, V193M, N194D, C198R, N201S, L203F, L203P, N207Q, L208P, V210A, S212G, D217G, D217V, I218N, I218T, E220G, R221G, R221I, R221K, I224V, T225A, T225S, N227K, or a conservative amino acid substitution thereof.

In some embodiments, the one or more amino acid modification, e.g. substitution is N52Y/N57Y/F138L/ L203P, N52H/N57Y/Q100P, N52S/Y146C/Y152C, N52H/ C198R, N52H/C140D/T225A, N52H/C198R/T225A, N52H/K92R, N52H/S99G, N57Y/Q100P, N52S/G103E, N52S/S130G/Y152C, N52S/Y152C, N52S/C198R, N52Y/ N57Y/Y152C, N52Y/N57Y/H129P/C198R, N52H/L161P/ C198R, N52H/T113E, N52D/S54P, N52K/L208P, N52S/ Y152H, N52D/V151A, N52H/I143T, N52S/L80P, F120S/ Y152H/N201S, N52S/R75Q/L203P, N52S/D158G, N52D/ Q133H, N52S/N57Y/H94D/L96F/L98F/Q100R, N52S/ N57Y/H94D/L96F/L98F/Q100R/G103E/F120S, N52H/ F78L/Q100R, N52H/N57Y/Q100R/V110D, N52H/N57Y/ R75Q/Q100R/V110D, N52H/N57Y/Q100R, N52H/N57Y/ L74Q/Q100R/V110D, N52H/Q100R, N52H/S121G, A20V/ N52H/N57Y/Q100R/S109G, N52H/N57Y/Q100P, N52H/ N57Y/R61S/Q100R/V110D/L173S, N52H/N57Y/Q100R/ V122A, N52H/N57Y/Q100R/F172S, N52H/N57Y, N52S/ F120S, N52S/V97A, N52S/G72R, N52S/A71T/A117T, N52S/E220G, Y47H/N52S/V107A/F120S, N52H/N57Y/ Q100R/V110D/S132F/M175T, E16V/N52H/N57Y/Q100R/ V110D/H115R/Y152C/K156M/C198R, Q37R/N52H/ N57Y/Q100R/V110N/S142F/C198R/D217V/R221G, N52H/N57Y/Q100R/V110D/C198R, N52H/N57Y/Q100R/ V110D/V116A/L161M/F172S/S192G/C198R, F27S/N52H/ N57Y/V110N, N52S/H94E/L96I/S109N/L166Q, S18R/ N52S/F93L/I143V/R221G, A20T/N52D/Y146C/Q164L, V11E/N30D/N52H/N57Y/H94E/L96I/L98F/N194D/ V210A/I218T, N52S/H94E/L96I/V122M, N52H/N57Y/ H94E/L96I/F120I/S126T/W153R/I218N, M10V/S18R/ N30D/N52S/S126R/T139S/L203F, S25G/N30D/N52S/ F120S/N227K, N30D/N52S/L67P/Q100K/D217G/R221K/ T225S, N52H/N57Y/Q100R/V110D/A117T/T190S/ C198R, N52H/N57Y/Q100R/V110D/F172S/C198R, S25G/ F27C/N52H/N57Y/Q100R/V110D/E135K/L173S/C198R, N52H/N57Y/V110A/C198R/R221I, M10I/S13G/N52H/ N57Y/D77G/V110A/H129P/I143V/F172S/V193M, C198R, N52H/N57Y/R61C/Y62F/Q100R/V110N/F120S/ C198R, N52H/N57Y/Q100R/V110D/H115R/C198R, N52H/N57Y/Q100R/V110D/N144D/F172S/C198R, N52S/ H94E/L98F/Q100R, N52S/E90A, N30D/K42E/N52S, N52S/F120S/I143V/I224V, N52H/N57Y/Q100R/V110D/ C198R/S212G, N52H/N57Y/Q100R/C198R, N52S/N194D, N52H/N57Y/Q100R/L102R/V110D/H115R/C198R, N52S/ S54P, T38P/N52S/N57D, N52H/C140del/T225A, N52H/ F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/ N57Y/Q100R/V110D/S132F/M175T, N52H/N57Y/Q100R/ V107I/V110D/I154F/C198R/R221G, Q100R, F138L/ L203P, N57Y/F138L/L203P, N57Y/Q100R/C198R, N57Y/ F138L/L203P, Q100R/F138L, L203P, N52H/N57Y/Q100R/ H115R/C198R, N52H/N57Y/Q100R/F172S/C198R, N52H/ N57Y/Q100R/H115R/F172S/C198R, N52H/N57Y/Q100R/ H115R/I143V/F172S/C198R, N52H/N57Y/Q100R/L102R/ H115R/F172S/C198R, N52H/V122A/F172S/C198R, N52H/N57Y/Q100R/H115R/F172S/N194D, N52H/N57Y/ H115R/F172S/C198R, N52H/N57Y/Q100R/H115R/ C198R, N52H/N57Y/H115R, N52H/N57Y/Q100R/H115R, N52H/N57Y/Q100R/H115R/F172S/I224V, N52H/N57Y/ Q100R/H115R/F172S, N52H/N57Y/Q100R/F172S, N52H/ Q100R/H115R/I143T/F172S, N52H/N57Y/Q100P/H115R/ F172S, N52Y/N57Y/Q100P/F172S, E16V/N52H/N57Y/ Q100R/V110D/H115R/C198R, E16V/N52H/N57Y/Q100R/ V110D/H115R/Y152C/K156M/F172S/C198R, N52S/ E90A/H115R, N30D/K42E N52S/H115R, N30D/K42E/ N52S/H115R/C198R/R221I, N30D/K42E/N52S/H115R/ C198R, N30D/K42E/N52S/H115R/F172S/N194D, N52S/ H115R/F120S/I143V/C198R, N52S/H115R/F172S/C198R, N52H/N57Y/Q100P/C198R, N52H/N57Y/Q100P H115R/ F172S/C198R, N52H/N57Y/Q100P/F172S/C198R, N52H/ N57Y/Q100P/H115R, N52H/N57Y/Q100P/H115R/C198R, N52H/Q100R/C198R, N52H/Q100R/H115R/F172S, N52H/ Q100R/F172S/C198R, N52H/Q100R/H115Q/F172S/ C198R, N52H/N57Y/Q100R/F172S/C198R, N52Q/N207Q, N168Q/N207Q, N52Q/NI68Q, N84Q/N207Q, N155Q/ N207Q, NI19Q/N168Q, N119Q/N207Q, N119Q/N155Q, N52Q/N84Q, N52Q/N119Q, N84Q/NI19Q, N52Q/N84Q/ N168Q, N52Q/N84Q/N207Q, N84Q/N155Q/N168Q, N84Q/N168Q/N207Q, N84Q/N155H/N207Q, N155Q/ N168Q/N207Q, N119Q/N155Q/N168Q, N119Q/N168Q/ N207Q, N84Q/N119Q/N207Q, N119Q/N155H/N207Q, N84Q/N119Q/N155Q, N52Q/N119Q/N155Q, N52H/ N84Q/N119Q, N52H/N84Q, N52H/N84Q/N168Q, N52H/ N84Q/N207Q, N52H/N84Q/N168Q/N207Q, N52Q/N84Q/ N155Q, N52Q/N84Q/N168Q, N52Q/N84Q/N155Q/ N168Q, N52Q/N84Q/N119Q/N168Q, N&4Q/NI19Q/ N155Q/N168Q, N84Q/N155Q/N168Q/N207Q, N84Q/ N119Q/N155Q/N207Q, N52Q/N84Q/N119Q/N207Q, N52Q/N84Q/N119Q/N155Q, N52Q/N84Q/N119Q/N155Q/ N207Q, N84Q/N119Q/N155Q/NI68Q/N207Q, N52A/ N57F/Q100S, N52A/N57H/Q100S, N52A/N57Y/Q100A, N52D/N57A/Q100A, N52D/Q100S, N52G/Q100A, N52H/ Q100A, N52M/N57Y/Q100S, N52M/N57W/Q100P, N52Q/ N57F, N52Q/N57S/Q100A, N52R/N57L/Q100A, N52R/ N57Y/Q100P, N52R/N57Y/Q100S, N52S/N57A/Q100A, N52S/N57H/Q100E, N52S/N57L/Q100S, N52S/N57M/ Q100S, N52S/N57Y/Q100S, N52S/N57Y/Q100M, N52S/ N57Y/Q100V, N52T/N57H/Q100S, N52T/N57H/Q100A, N52T/N57Y/Q100A, N52V/N57L/Q100A, N52H/N57Y/ Q100K, N52K/N57Y/Q100R, N52L/N57H/Q100R, N52R/ N57F/Q100N, N52R/N57F/Q100P, N52R/N57F/Q100R, N52R/N57F/Q100T, N52R/N57H/Q100K, N52R/N57L/ Q100S, N52R/N57W/Q100K, N52R/N57W, N52R/N57Y/ Q100R, N52C/N57E/Q100S. N52G/N57P/Q100D, N52G/ N57V/Q100G, N52G/N57V, N52L/N57V, N52P/N57P, N52P/N57S/Q100G, N52S/N57L/Q100G, N52T/N57K/ Q100P, N52V/N57T/Q100L, or N57Q/Q100P.

In some embodiments, the one or more amino acid modifications are selected from among N52Y/N57Y/F138L/ L203P, N52H/N57Y/Q100P, N52S/Y146C/Y152C, N52H/ C198R, N52H/C140D/T225A. N52H/C198R/T225A, N52H/K92R, N52H/S99G, N57Y/Q100P, N52S/S130G/ Y152C, N52S/Y152C, N52S/C198R, N52Y/N57Y/Y152C, N52Y/N57Y/H129P/C198R, N52H/LI61P/C198R, N52S/ T113E, N52D/S54P, N52K/L208P, N52S/Y152H, N52D/ V151A, N52H/I143T, N52S/L80P, F120S/Y152H/N201S, N52S/R75Q/L203P, N52S/D158G, N52D/QI33H, N52S/ N57Y/H94D/L96F/L98F/Q100R, N52S/N57Y/H94D/ L96F/L98F/Q100R/G103E/F120S, N52S/G103E, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/R61S/Q100R/V110D/L173S, N52H/N57Y/Q100R/V122A, N52H/N57Y/Q100R/FI72S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R. Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/

N52S/S126R/T139S/L203F, S25G/N30D/N52S/F120S/ N227K, N30D/N52S/L67P/Q100K/D217G/R221K/T225S, N52H/N57Y/Q100R/V110D/A117T/T190S/C198R, N52H/ N57Y/Q100R/V110D/F172S/C198R, S25G/F27C/N52H/ N57Y/Q100R/V110D/E135K/L173S/C198R, N52H/N57Y/ V110A/C198R/R221I, M10I/S13G/N52H/N57Y/D77G/ V110A/H129P/I143V/F172S/V193M, C198R, N52H/ N57Y/R61C/Y62F/Q100R/V110N/F120S/C198R, N52H/ N57Y/Q100R/V110D/H115R/C198R, N52H/N57Y/ Q100R/V110D/N144D/F172S/C198R, N52S/H94E/L98F/ Q100R, N52S/E90A, N30D/K42E/N52S, N52S/F120S/ I143V/I224V, N52H/N57Y/Q100R/V110D/C198R/S212G, N52H/N57Y/Q100R/C198R, N52S/N194D, N52H/N57Y/ Q100R/L102R/V110D/H115R/C198R, N52H/N57Y/ Q100R/V110D/C198R/S212G, N52H/N57Y/Q100R/ C198R, N52S/N194D, N52H/N57Y/Q100R/L102R/ V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/ V110D/S192G, N52H/S121G/C198R, N52S/F120S/ N227K, N52S/A71T/A117T/T190A/C198R, T43A/N52H/ N57Y/L74Q/D89G/V110D/F172S, N52H/N57Y/Q100R/ V110D/S132F/M175T, N52H/N57Y/Q100R/V107I/ V110D/I154F/C198R/R221G, N52Q/N207Q, N168Q/ N207Q, N52Q/N168Q, N84Q/N207Q, N155Q/N207Q, N119Q/N168Q, N119Q/N207Q, N119Q/N155Q, N52Q/ N84Q, N52Q/N119Q, N84Q/N119Q, N52Q/N84Q/N168Q, N52Q/N84Q/N207Q, N84Q/N155Q/N168Q, N84Q/ N168Q/N207Q, N84Q/N155H/N207Q, N155Q/N168Q/ N207Q, N119Q N155Q/N168Q, N119Q/N168Q/N207Q, N84Q/N119Q/N207Q, N119Q/N155H/N207Q, N84Q/ N119Q/N155Q, N52Q/N119Q/N155Q, N52H/N84Q/ N119Q, N52H/N84Q, N52H/N84Q/N168Q/N207Q, N52Q/ N84Q/N155Q/N168Q, N52Q/N84Q/N119Q/N168Q, N84Q/N119Q/N155Q/N168Q, N84Q/N155Q/N168Q/ N207Q, N84Q/N119Q/N155Q/N207Q, N52Q/N84Q/ N119Q/N207Q, N52Q/N84Q/N119Q/N155Q, N52Q/ N84Q/N119Q/N155Q/N207Q, N84Q/N119Q/N155Q/ N168Q/N207Q, F138L/L203P, N52Y/F138L/L203P, N57Y/ Q100R/C198R, N57Y/F138L/L203P, Q100R/F138L, N52H/N57Y/Q100R/H115R/C198R, N52H/N57Y/Q100R/ F172S/C198R, N52H/N57Y/Q100R/H115R/F172S/C198R, N52H/N57Y/Q100R/H115R/I143V/F172S/C198R, N52H/ N57Y/Q100R/L102R/H115R/F172S/C198R, N52H/ V122A/F172S/C198R, N52H/N57Y/Q100R/H115R/ F172S/N194D, N52H/N57Y/H115R/F172S/C198R, N52H/ N57Y/H115R, N52H/N57Y/Q100R/H115R, N52H/N57Y/ Q100R/H115R/F172S/I224V, N52H/N57Y/Q100R/H115R/ F172S, N52H/N57Y/Q100R/F172S, N52H/Q100R/H115R/ I143T/F172S, N52H/N57Y/Q100P/H115R/F172S, N52Y/ N57Y/Q100P/F172S, E16V/N52H/N57Y/Q100R/V110D/ H115R/C198R, E16V/N52H/N57Y/Q100R/V110D/H115R/ Y152C/K156M/F172S/C198R, N52S/E90A/H115R, N30D/ K42E N52S/H115R, N30D/K42E/N52S/H115R/C198R/ R221I, N30D/K42E/N52S/H115R/C198R, N30D/K42E/ N52S/H115R/F172S/N194D, N52S/H115R/F120S/I143V/ C198R, N52S/H115R/F172S/C198R, N52H/N57Y/Q100P/ C198R, N52H/N57Y/Q100P/H115R/F172S/C198R, N52H/ N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115R/F172S/C198R, N52H/N57Y/Q100R/ F172S/C198R, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/ N57W/Q100P, N52Q/N57F, N52Q/N57S/Q100A, N52R/ N57L/Q100A, N52R/N57Y/Q100P, N52R/N57Y/Q100S, N52S/N57A/Q100A, N52S/N57H/Q100E, N52S/N57L/ Q100S, N52S/N57M/Q100S, N52S/N57Y/Q100S, N52S/ N57Y/Q100M, N52S/N57Y/Q100V, N52T/N57H/Q100S, N52T/N57H/Q100A, N52T/N57Y/Q100A, N52V/N57L/ Q100A, N52H/N57Y/Q100K, N52K/N57Y/Q100R, N52L/ N57H/Q100R, N52R/N57F/Q100N, N52R/N57F/Q100P, N52R/N57F/Q100R, N52R/N57F/Q100T, N52R/N57H/ Q100K, N52R/N57L/Q100S, N52R/N57W/Q100K, N52R/ N57W, N52R/N57Y/Q100R, N52C/N57E/Q100S, N52G/ N57P/Q100D, N52G/N57V/Q100G, N52G/N57V, N52L/ N57V, N52P/N57P, N52P/N57S/Q100G, N52S/N57L/ Q100G, N52T/N57K/Q100P, N52V/N57T/Q100L, N57Q/ Q100P, S54F/V193A or R26S/N52H/N57Y/V110D/T137A/ C198R.

In some embodiments, the variant ICOSL polypeptide comprises any of the mutations listed in Table 1. Table 1 also provides exemplary sequences by reference to SEQ ID NO for the extracellular domain (ECD) or IgV domain of the reference (e.g., unmodified) or wild-type ICOSL or exemplary variant ICOSL polypeptides. As indicated, the exact locus or residues corresponding to a given domain can vary, such as depending on the methods used to identify or classify the domain. Also, in some cases, adjacent N- and/or C-terminal amino acids of a given domain (e.g. IgV) also can be included in a sequence of a variant IgSF polypeptide, such as to ensure proper folding of the domain when expressed. Thus, it is understood that the exemplification of the SEQ ID NOSs in Table 1 is not to be construed as limiting. For example, the particular domain, such as the ECD domain, of a variant ICOSL polypeptide can be several amino acids longer or shorter, such as 1-10, e.g., 1, 2, 3, 4, 5, 6 or 7 amino acids longer or shorter, than the sequence of amino acids set forth in the respective SEQ ID NO.

In some embodiments, the variant ICOSL polypeptide comprises any of the mutations listed in Table 1. In some examples, the mutations are made in a reference ICOSL containing the sequence of amino acids set forth in SEQ ID NO: 32, a reference ICOSL that contains the IgV domain of ICOSL set forth in SEQ ID NOs: 196 or 545, or a reference ICOSL that is truncated and/or modified containing the sequence of amino acids set forth in any of SEQ ID NOs: 600-628. In some embodiments, the variant ICOSL polypeptide comprises any of the extracellular domain (ECD) sequences listed in Table 1 (i.e., any one of SEQ ID NOS: 109-142, 239, 280-325, 364-381, 387-424, 427-433, 435-470, 638-685). In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 1 (i.e., any one of SEQ ID NOS: 109-142, 239, 280-325, 364-381, 387-424, 427-433, 435-470, 638-685) and contains the amino acid modification(s), e.g. substitution(s) not present in the reference (e.g., unmodified) or wild-type ICOSL. In some embodiments, the variant ICOSL polypeptide comprises a specific binding fragment of any of the extracellular domain (ECD) sequences listed in Table 1 (i.e., any one of SEQ ID NOS: 109-142, 239, 280-325, 364-381, 387-424, 427-433, 435-470, 638-685) and contains the amino acid modification(s), e.g. substitution (s) not present in the reference (e.g., unmodified) or wild-type ICOSL.

In some embodiments, the variant ICOSL polypeptide comprises any of the extracellular domain (ECD) sequences listed in Table 1 (i.e., any one of SEQ ID NOS: 109-142, 239, 280-325, 364-381, 387-424, 427-433, 435-470, 638-

685, 905, 908). In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) sequences listed in Table 1 (i.e., any one of SEQ ID NOS: 109-142, 239, 280-325, 364-381, 387-424, 427-433, 435-470, 638-685, 905, 908) and contains the amino acid modification(s), e.g. substitution(s) not present in the reference (e.g., unmodified) or wild-type ICOSL. In some embodiments, the variant ICOSL polypeptide comprises a specific binding fragment of any of the extracellular domain (ECD) sequences listed in Table 1 (i.e., any one of SEQ ID NOS: 109-142, 239, 280-325, 364-381, 387-424, 427-433, 435-470, 638-685, 905, 908) and contains the amino acid modification(s), e.g. substitution (s) not present in the reference (e.g., unmodified) or wild-type ICOSL.

In some embodiments, the variant ICOSL polypeptide comprises any of the IgV sequences listed in Table 1 (i.e., any one of SEQ ID NOS: 197-199, 201-208, 210, 212, 240, 326-340, 382-386, 425-426, 434, 546-599, 686-857). In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 1 (i.e., any one of SEQ ID NOS: 197-199, 201-208, 210, 212, 240, 326-340, 382-386, 425-426, 434, 546-599, 686-857) and contains the amino acid modification(s), e.g. substitution(s) not present in the reference (e.g., unmodified) or wild-type ICOSL. In some embodiments, the variant ICOSL polypeptide comprises a specific binding fragment of any of the IgV sequences listed in Table 1 (i.e., any one of SEQ ID NOS: 197-199, 201-208, 210, 212, 240, 326-340, 382-386, 425-426, 434, 546-599, 686-857) and contains the amino acid substitution(s) not present in the reference (e.g., unmodified) or wild-type ICOSL.

In some embodiments, the variant ICOSL polypeptide comprises any of the IgV sequences listed in Table 1 (i.e., any one of SEQ ID NOS: 197-199, 201-208, 210, 212, 240, 326-340, 382-386, 425-426, 434, 546-599, 686-857, 906-907, 909-910). In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences listed in Table 1 (i.e., any one of SEQ ID NOS: 197-199, 201-208, 210, 212, 240, 326-340, 382-386, 425-426, 434, 546-599, 686-857, 906-907, 909-910) and contains the amino acid modification(s), e.g. substitution(s) not present in the reference (e.g., unmodified) or wild-type ICOSL. In some embodiments, the variant ICOSL polypeptide comprises a specific binding fragment of any of the IgV sequences listed in Table 1 (i.e., any one of SEQ ID NOS: 197-199, 201-208, 210, 212, 240, 326-340, 382-386, 425-426, 434, 546-599, 686-857, 906-907, 909-910) and contains the amino acid substitution(s) not present in the reference (e.g., unmodified) or wild-type ICOSL.

Mutations designated with an "X" indicate the designated position contains a Q or the wild-type residue set forth in the corresponding position of SEQ ID NO: 32.

TABLE 1

Exemplary variant ICOSL polypeptides

| Mutation(s) | ECD SEQ ID NO | IgV SEQ ID NO |
|---|---|---|
| Wild-type | 32 | 196, 545 |
| N52S | 109 | 197, 546 |
| N52H | 110 | 198, 547 |
| N52D | 111 | 199, 548 |
| N52Y/N57Y/F138L/L203P | 112 | 782, 783 |
| N52H/N57Y/Q100P | 113 | 201, 549 |
| N52S/Y146C/Y152C | 114 | 197, 546 |
| N52H/C198R | 115 | 198, 547 |
| N52H/C140D/T225A | 116 | 198, 547 |
| N52H/C198R/T225A | 117 | 198, 547 |
| N52H/K92R | 118 | 202, 550 |
| N52H/S99G | 119 | 203, 551 |
| N52Y | 120 | 204, 552 |
| N57Y | 121 | 205, 553 |
| N57Y/Q100P | 122 | 206, 554 |
| N52S/S130G/Y152C | 123 | 197, 546 |
| N52S/Y152C | 124 | 197, 546 |
| N52S/C198R | 125 | 197, 546 |
| N52Y/N57Y/Y152C | 126 | 782, 783 |
| N52Y/N57Y/H129P/C198R | 127 | 782, 783 |
| N52H/L161P/C198R | 128 | 198, 547 |
| N52S/T113E | 129 | 197, 555 |
| S54A | 130 | 207, 556 |
| N52D/S54P | 131 | 208, 557 |
| N52K/L208P | 132 | 785, 786 |
| N52S/Y152H | 133 | 197, 546 |
| N52D/V151A | 134 | 199, 548 |
| N52H/I143T | 135 | 198, 547 |
| N52S/L80P | 136 | 210, 558 |
| F120S/Y152H/N201S | 137 | 196, 545 |
| N52S/R75Q/L203P | 138 | 787, 788 |
| N52S/D158G | 139 | 197, 546 |
| N52D/Q133H | 140 | 199, 548 |
| N52S/N57Y/H94D/L96F/L98F/Q100R | 141 | 212, 559 |
| N52S/N57Y/H94D/L96F/L98F/Q100R/G103E/F120S | 142 | 789, 560 |
| N52S/G103E | 239 | 240, 561 |
| N52H/F78L/Q100R | 280 | 326, 562 |
| N52H/N57Y/Q100R/V110D | 281 | 327, 563 |
| N52H/N57Y/R75Q/Q100R/V110D | 282 | 328, 564 |
| N52H/N57Y/Q100R | 283 | 329, 565 |
| N52H/N57Y/L74Q/Q100R/V110D | 284 | 330, 566 |
| N52H/Q100R | 285 | 331, 567 |
| N52H/S121G | 286 | 198, 568 |
| A20V/N52H/N57Y/Q100R/S109G | 287 | 332, 569 |
| N52H/N57Y/Q100P | 288 | 333, 570 |
| N52H/N57Y/R61S/Q100R/V110D/L173S | 289 | 791, 792 |
| N52H/N57Y/Q100R/V122A | 290 | 329, 571 |
| N52H/N57Y/Q100R/F172S | 291 | 329, 565 |
| N52H/N57Y | 292 | 334, 572 |
| N52S/F120S | 293 | 197, 573 |
| N52S/V97A | 294 | 335, 574 |
| N52S/G72R | 295 | 336, 575 |
| N52S/A71T/A117T | 296 | 793, 576 |
| N52S/E220G | 297 | 197, 546 |
| Y47H/N52S/V107A/F120S | 298 | 794, 577 |
| N52H/N57Y/Q100R/V110D/S132F/M175T | 299 | 327, 563 |
| E16V/N52H/N57Y/Q100R/V110D/H115R/Y152C/K156M/C198R | 300 | 795, 796 |
| Q37R/N52H/N57Y/Q100R/V110N/S142F/C198R/D217V/R221G | 301 | 797, 798 |
| N52H/N57Y/Q100R/V110D/C198R | 302 | 327, 563 |
| N52H/N57Y/Q100R/V110D/V116A/L161M/F172S/S192G/C198R | 303 | 799, 800 |
| F27S/N52H/N57Y/V110N | 304 | 337, 578 |
| N52S/H94E/L96I/S109N/L166Q | 305 | 801, 802 |
| S18R/N52S/F93L/I143V/R221G | 306 | 803, 804 |
| A20T/N52D/Y146C/Q164L | 307 | 805, 806 |
| V11E/N30D/N52H/N57Y/H94E/L96I/L98F/N194D/V210A/I218T | 308 | 807, 808 |
| N52S/H94E/L96I/V122M | 309 | 809, 579 |

TABLE 1-continued

Exemplary variant ICOSL polypeptides

| Mutation(s) | ECD SEQ ID NO | IgV SEQ ID NO |
|---|---|---|
| N52H/N57Y/H94E/L96I/F120I/S126T/W153R/I218N | 310 | 810, 811 |
| M10V/S18R/N30D/N52S/S126R/T139S/L203F | 311 | 812, 813 |
| S25G/N30D/N52S/F120S/N227K | 312 | 814, 815 |
| N30D/N52S/L67P/Q100K/D217G/R22IK/T225S | 313 | 816, 817 |
| N52H/N57Y/Q100R/V110D/A117T/T190S/C198R | 314 | 327, 818 |
| N52H/N57Y/Q100R/V110D/F172S/C198R | 315 | 327, 563 |
| S25G/F27C/N52H/N57Y/Q100R/V110D/E135K/L173S/C198R | 316 | 819, 820 |
| N52H/N57Y/V110A/C198R/R221I | 317 | 821, 822 |
| M10I/S13G/N52H/N57Y/D77G/V110A/H129P/I143V/F172S/V193M/C198R | 318 | 823, 824 |
| N52H/N57Y/R61C/Y62F/Q100R/V110N/F120S/C198R | 319 | 825, 826 |
| N52H/N57Y/Q100R/V110D/H115R/C198R | 320 | 327, 827 |
| N52H/N57Y/Q100R/V110D/N144D/F172S/C198R | 321 | 327, 563 |
| N52S/H94E/L98F/Q100R | 322 | 338, 580 |
| N52S/E90A | 323 | 339, 581 |
| N30D/K42E/N52S | 324 | 340, 582 |
| N52S/F120S/I143V/I224V | 325 | 197, 573 |
| N52H/N57Y/Q100R/V110D/C198R/S212G | 364 | 828, 829 |
| N52H/N57Y/Q100R/C198R | 365 | 329, 565 |
| N52S/N194D | 366 | 197, 546 |
| N52H/N57Y/Q100R/L102R/V110D/H115R/C198R | 367 | 830, 831 |
| N52S/S54P | 368 | 382, 583 |
| T38P/N52S/N57D | 369 | 383, 584 |
| E111del | 370 | 384, 585 |
| Y33del | 371 | 385, 586 |
| N52H/C140del/T225A | 372 | 198, 547 |
| N52H/F78L/Q100R/C198R | 373 | 326, 562 |
| N52H/N57Y/R75Q/Q100P/V110D | 374 | 386, 587 |
| N52H/N57Y/L74Q/V110D/S192G | 375 | 832, 833 |
| N52H/S121G/C198R | 376 | 198, 568 |
| N52S/F120S/N227K | 377 | 197, 573 |
| N52S/A71T/A117T/T190A/C198R | 378 | 793, 576 |
| T43A/N52H/N57Y/L74Q/D89G/V110D/F172S | 379 | 790, 834 |
| N52H/N57Y/Q100R/V110D/S132F/M175T | 380 | 327, 563 |
| N52H/N57Y/Q100R/V107I/V110D/I154F/C198R/R221G | 381 | 835, 836 |
| N84Q | 387 | 425, 588 |
| N119Q | 388 | 196, 842 |
| N168Q | 389 | 196, 545 |
| N207Q | 390 | 196, 545 |
| N52Q/N207X | 391 | 837, 838 |
| N168X/N207X | 392 | 196, 545 |
| N52Q/N168Q | 393 | 837, 838 |
| N84Q/N207Q | 394 | 425, 840 |
| N155Q/N207Q | 395 | 196, 545 |
| N119Q/N168Q | 396 | 196, 842 |
| N119Q/N207Q | 397 | 196, 842 |
| N119Q/N155X | 398 | 196, 842 |
| N52Q/N84Q | 399 | 426, 590 |
| N52Q/N119Q | 400 | 837, 591 |
| N84Q/N119Q | 401 | 425, 592 |
| N52Q/N84Q/N168Q | 402 | 426, 590 |
| N52Q/N84Q/N207Q | 403 | 426, 590 |
| N84Q/N155Q/N168Q | 404 | 425, 588 |
| N84Q/N168Q/N207Q | 405 | 425, 588 |
| N84Q/N155H/N207Q | 406 | 425, 588 |
| N155Q/N168Q/N207Q | 407 | 196, 545 |
| N119Q/N155Q/N168Q | 408 | 196, 842 |
| N119Q/N168Q/N207Q | 409 | 196, 842 |
| N84Q/N119Q/N207Q | 410 | 425, 592 |

TABLE 1-continued

Exemplary variant ICOSL polypeptides

| Mutation(s) | ECD SEQ ID NO | IgV SEQ ID NO |
|---|---|---|
| N119Q/N155H/N207Q | 411 | 196, 842 |
| N84Q/N119Q/N155Q | 412 | 425, 592 |
| N52Q/N119Q/N155Q | 413 | 837, 591 |
| N52H/N84Q/N119Q | 414 | 839, 593 |
| N52Q/N84Q/N168X/N207X | 415 | 839, 841 |
| N52Q/N84Q/N155X/N168X | 416 | 426, 590 |
| N52Q/N84Q/N119Q/N168Q | 417 | 426, 843 |
| N84Q/N119Q/N155Q/N168Q | 418 | 425, 592 |
| N84Q/N155Q/N168Q/N207Q | 419 | 425, 588 |
| N84Q/N119Q/N155Q/N207Q | 420 | 425, 592 |
| N52Q/N84Q/N119Q/N207Q | 421 | 426, 843 |
| N52Q/N84Q/N119Q/N155Q | 422 | 426, 843 |
| N52Q/N84Q/N119Q/N155Q/N207Q | 423 | 426, 843 |
| N84Q/N119Q/N155Q/N168Q/N207Q | 424 | 425, 592 |
| Q100R | 427 | 434, 594 |
| F138L/L203P | 428 | 196, 545 |
| N52Y/F138L/L203P | 429 | 204, 552 |
| N57Y/Q100R/C198R | 430 | 844, 845 |
| N57Y/F138L/L203P | 431 | 205, 553 |
| Q100R/F138L | 432 | 846, 847 |
| L203P | 433 | 196, 545 |
| N52H/N57Y/Q100R/H115R/C198R | 435 | 329, 596 |
| N52H/N57Y/Q100R/F172S/C198R | 436 | 329, 565 |
| N52H/N57Y/Q100R/H115R/F172S/C198R | 437 | 329, 596 |
| N52H/N57Y/Q100R/H115R/I143V/F172S/C198R | 438 | 329, 596 |
| N52H/N57Y/Q100R/L102R/H115R/F172S/C198R | 439 | 849, 850 |
| N52H/V122A/F172S/C198R | 440 | 198, 851 |
| N52H/N57Y/Q100R/H115R/F172S/N194D | 441 | 329, 596 |
| N52H/N57Y/H115R/F172S/C198R | 442 | 334, 595 |
| N52H/N57Y/Q100R/H115R/C198R | 443 | 329, 596 |
| N52H/N57Y/H115R | 444 | 334, 595 |
| N52H/N57Y/Q100R/H115R | 445 | 329, 596 |
| N52H/N57Y/Q100R/H115R/F172S/I224V | 446 | 329, 596 |
| N52H/N57Y/Q100R/H115R/F172S | 447 | 329, 596 |
| N52H/N57Y/Q100R/F172S | 448 | 329, 565 |
| N52H/Q100R/H115R/I143T/F172S | 449 | 331, 852 |
| N52H/N57Y/Q100P/H115R/F172S | 450 | 333, 853 |
| N52Y/N57Y/Q100P/F172S | 451 | 854, 855 |
| E16V/N52H/N57Y/Q100R/V110D/H115R/C198R | 452 | 795, 796 |
| E16V/N52H/N57Y/Q100R/V110D/H115R/Y152C/K156M/F172S/C198R | 453 | 795, 796 |
| N52S/E90A/H115R | 454 | 339, 597 |
| N30D/K42E/N52S/H115R | 455 | 856, 598 |
| N30D/K42E/N52S/H115R/C198R/R221I | 456 | 856, 598 |
| N30D/K42E/N52S/H115R/C198R | 457 | 856, 598 |
| N30D/K42E/N52S/H115R/F172S/N194D | 458 | 856, 598 |
| N52S/H115R/F120S/I143V/C198R | 459 | 197, 857 |
| N52S/H115R/F172S/C198R | 460 | 197, 853 |
| N52H/N57Y/Q100P/C198R | 461 | 333, 570 |
| N52H/N57Y/Q100P/H115R/F172S/C198R | 462 | 333, 599 |
| N52H/N57Y/Q100P/F172S/C198R | 463 | 333, 570 |
| N52H/N57Y/Q100P/H115R | 464 | 333, 599 |
| N52H/N57Y/Q100P/H115R/C198R | 465 | 333, 599 |
| N52H/Q100R/C198R | 466 | 331, 567 |
| N52H/Q100R/H115R/F172S | 467 | 331, 852 |
| N52H/Q100R/H115X/F172S/C198R | 468 | 331, 848 |
| N52H/Q100R/H115R/F172S/C198R | 469 | 331, 852 |
| N52H/N57Y/Q100R/F172S/C198R | 470 | 329, 565 |
| N52A/N57F/Q100S | 638 | 686, 734 |
| N52A/N57H/Q100S | 639 | 687, 735 |
| N52A/N57Y/Q100A | 640 | 688, 736 |
| N52D/N57A/Q100A | 641 | 689, 737 |
| N52D/Q100S | 642 | 690, 738 |
| N52G/Q100A | 643 | 691, 739 |

TABLE 1-continued

Exemplary variant ICOSL polypeptides

| Mutation(s) | ECD SEQ ID NO | IgV SEQ ID NO |
|---|---|---|
| N52H/Q100A | 644 | 692, 740 |
| N52M/N57H/Q100S | 645 | 693, 741 |
| N52M/N57W/Q100P | 646 | 694, 742 |
| N52Q/N57F | 647 | 695, 743 |
| N52Q/N57S/Q100A | 648 | 696, 744 |
| N52R/N57L/Q100A | 649 | 697, 745 |
| N52R/N57Y/Q100P | 650 | 698, 746 |
| N52R/N57Y/Q100S | 651 | 699, 747 |
| N52S/N57A/Q100A | 652 | 700, 748 |
| N52S/N57H/Q100E | 653 | 701, 749 |
| N52S/N57L/Q100S | 654 | 702, 750 |
| N52S/N57M/Q100S | 655 | 703, 751 |
| N52S/N57Y/Q100S | 656 | 704, 752 |
| N52S/N57Y/Q100M | 657 | 705, 753 |
| N52S/N57Y/Q100V | 658 | 706, 754 |
| N52T/N57H/Q100S | 659 | 707, 755 |
| N52T/N57H/Q100A | 660 | 708, 756 |
| N52T/N57Y/Q100A | 661 | 709, 757 |
| N52V/N57L/Q100A | 662 | 710, 758 |
| N52H/N57Y/Q100K | 663 | 711, 759 |
| N52K/N57Y/Q100R | 664 | 712, 760 |
| N52L/N57H/Q100R | 665 | 713, 761 |
| N52R/N57F/Q100N | 666 | 714, 762 |
| N52R/N57F/Q100P | 667 | 715, 763 |
| N52R/N57F/Q100R | 668 | 716, 764 |
| N52R/N57F/Q100T | 669 | 717, 765 |
| N52R/N57H/Q100K | 670 | 718, 766 |
| N52R/N57L/Q100S | 671 | 719, 767 |
| N52R/N57W/Q100K | 672 | 720, 768 |
| N52R/N57W | 673 | 721, 769 |
| N52R/N57Y/Q100R | 674 | 722, 770 |
| N52C/N57E/Q100S | 675 | 723, 771 |
| N52G/N57P/Q100D | 676 | 724, 772 |
| N52G/N57V/Q100G | 677 | 725, 773 |
| N52G/N57V | 678 | 726, 774 |
| N52L/N57V | 679 | 727, 775 |
| N52P/N57P | 680 | 728, 776 |
| N52P/N57S/Q100G | 681 | 729, 777 |
| N52S/N57L/Q100G | 682 | 730, 778 |
| N52T/N57K/Q100P | 683 | 731, 779 |
| N52V/N57T/Q100L | 684 | 732, 780 |
| N57Q/Q100P | 685 | 733, 781 |
| S54F/V193A | 905 | 906, 907 |
| R26S/N52H/N57Y/V110D/T137A/C198R | 908 | 909, 910 |

In some embodiments, the variant ICOSL polypeptide exhibits increased affinity for the ectodomain of CD28 compared to the reference (e.g., unmodified) or wild-type ICOSL polypeptide, such as comprising the sequence set forth in SEQ ID NO: 32, 196, or 545. In some embodiments, the ICOSL polypeptide exhibits increased affinity for the ectodomain of ICOS compared to the reference (e.g., unmodified) or wild-type ICOSL, such as comprising the sequence set forth in SEQ ID NO: 32, 196, or 545. In some embodiments, the ICOSL polypeptide exhibits increased affinity for the ectodomain of CD28 and the ectodomain of ICOS compared to the reference (e.g., unmodified) or wild-type ICOSL, such as comprising the sequence set forth in SEQ ID NO: 32, 196, or 545.

In some embodiments, the variant ICOSL polypeptide has one or more amino acid modification, e.g. substitution corresponding to position(s) 52, 54 or 57. In some embodiments, the variant ICOSL polypeptide has one or more amino acid modification, e.g. substitution selected from N52H, N52D, N52Q, N52S, N52Y, N52K, S54A, S54P, or N57Y or a conservative amino acid modification, e.g. substitution thereof. In some embodiments, the variant ICOSL polypeptide has one or more amino acid modification, e.g. substitution selected from N52H, N52D, N52S, N52K or N57Y or a conservative amino acid modification, e.g. substitution thereof.

In some embodiments, the variant ICOSL polypeptide can contain one or more further amino acid modification, e.g. substitution in addition to an amino acid modification, e.g. substitution at a position corresponding to position 52, 54 or 57. In some embodiments, the one or more further amino acid modification, e.g. substitution is at a position corresponding to 10, 11, 13, 16, 18, 20, 25, 27, 30, 37, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 113, 115, 116, 117, 119, 120, 121, 122, 126, 129, 130, 132, 133, 135, 138, 139, 140, 142, 143, 144, 146, 151, 152, 153, 154, 155, 156, 158, 161, 166, 168, 172, 173, 175, 190, 192, 193, 194, 198, 201, 203, 207, 208, 210, 212, 217, 218, 220, 221, 224, 225 or 227. In some embodiments, the one or more further amino acid modification, e.g. substitution is at a position corresponding to 10, 11, 13, 16, 18, 20, 25, 26, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 137, 138, 139, 140, 142, 143, 144, 146, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32.

In some embodiments, the variant ICOSL contains one or more further amino acid modification, e.g. substitution selected from M10V, M10I, V11E, S13G, E16V, S18R, A20V, S25G, F27S, F27C, N30D, Y33del, Q37R, K42E, T43A, Y47H, N52H, N52D, N52S, N52Y, N52K, N52Q, S54A, S54P, N57D, N57Y, R61S, R61C, Y62F, L67P, A71T, G72R, L74Q, R75Q, D77G, F78L, L80P, N84Q, D89G, E90A, K92R, F93L, H94E, H94D, L96F, L96I, V97A, L98F, S99G, Q100R, Q100K, Q100P, L102R, G103E, V107A, V107I, S109G, S109N, V110D, V110N, V110A, E111del, T113E, H115R, H115Q, V116A, A117T, N119Q, F120I, F120S, S121G, V122A, V122M, S126T, S126R, H129P, S130G, S132F, Q133H, E135K, F138L, T139S, C140del, S142F, I143V, I143T, N144D, Y146C, V151A, Y152C, Y152H, W153R, I154F, K156M, D158G, L161P, L161M, L166Q, N168Q, F172S, L173S, M175T, T190A, T190S, S192G, V193M, N194D, C198R, N201S, L203P, L203F, N207Q, L208P, V210A, S212G, D217V, I218T, I218N, E220G, R221G, R221I, I224V, T225A, N227K, or a conservative amino acid substitution thereof. In some embodiments, the variant ICOSL contains one or more further amino acid modification, e.g. substitution selected from M10V, M10I, V11E, S13G, E16V, S18R, A20T, A20V, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110A, V110D, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193A, V193M, N194D, C198R, N201S, L203F, L203P, N207Q, L208P, V210A, S212G, D217G, D217V, I218N, I218T, E220G, R221G, R221I, R221K, I224V, T225A, T225S, N227K, or a conservative amino acid substitution thereof.

In some embodiments of any one of the variant ICOSL polypeptides described above, the variant ICOSL polypeptide further comprises one or more amino acid deletions corresponding to positions 140 of SEQ ID NO: 32.

In some embodiments, the variant ICOSL polypeptide has one or more amino acid modification, e.g. substitution selected from N52Y/N57Y/F138L/L203P, N52H/N57Y/Q100P, N52S/Y146C/Y152C, N52H/C198R, N52H/C140del/T225A, N52H/C198R/T225A, N52H/K92R, N57Y/Q100P, N52S/C198R, N52Y/N57Y/Y152C, N52Y/N57Y/H129P/C198R, N52H/L161P/C198R, N52S/T113E, N52S/S54P, N52K/L208P, N52S/Y152H, N52H/I143T, N52S/R75Q/L203P, N52S/D158G, N52D/Q133H, N52H/N57Y/Q100R/V110D/C198R/S212G, N52H/N57Y/Q100R/C198R, N52S/N194D, N52H/N57Y/Q100R/L102R/V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/N57Y/Q100R/V110D/S132F/M175T, N52H/N57Y/Q100R/V107I/V110D/I154F/C198R/R221G, N52Q/N207Q, N52Q/N168Q, N52Q/N84Q, N52Q/N119Q, N52Q/N84Q/N168Q, N52Q/N84Q/N207Q, N52Q/N119Q/N155Q, N52H/N84Q/N119Q, N52H/N84Q/N207Q, N52H/N84Q/N168Q, N52H/N84Q/N207Q, N52H/N84Q/N168Q/N207Q, N52Q/N84Q/N155Q, N52Q/N84Q/N168Q, N52Q/N84Q/N155Q/N168Q, N52Q/N84Q/N119Q/N168Q, N52Q/N84Q/N119Q/N207Q, N52Q/N84Q/N119Q/N155Q, N52Q/N84Q/N119Q/N155Q/N207Q, N52Y/F138L/L203P, N57Y/Q100R/C198R, N57Y/F138L/L203P, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/V122A/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/N57Y/Q100R/H115R, N52H/N57Y/Q100R/H115R/F172S/I224V, N52H/N57Y/Q100R/H115R/F172S, N52H/N57Y/Q100R/F172S, N52H/Q100R/H115R/I143T/F172S, N52H/N57Y/Q100P/H115R/F172S, N52Y/N57Y/Q100P/F172S, E16V/N52H/N57Y/Q100R/V110D/H115R/C198R, E16V/N52H/N57Y/Q100R/V110D/H115R/Y152C/K156M/F172S/C198R, N52S/E90A/H115R, N30D/K42E/N52S/H115R, N30D/K42E/N52S/H115R/C198R/R221I, N30D/K42E/N52S/H115R/C198R, N30D/K42E/N52S/H115R/F172S/N194D, N52S/H115R/F120S/I143V/C198R, N52S/H115R/F172S/C198R, N52H/N57Y/Q100P/C198R, N52H/N57Y/Q100P H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115R/F172S/C198R, or N52H/N57Y/Q100R/F172S/C198R.

In some embodiments, the variant ICOSL polypeptide has one or more amino acid modification, e.g. substitution in an reference ICOSL or specific binding fragment there of corresponding to position(s) 52, 57, or 100 with reference to numbering of SEQ ID NO:32. In some embodiments, the variant ICOSL polypeptide has one or more amino acid modification, e.g. substitution selected from N52A, N52C, N52D, N52G, N52H, N52L, N52K, N52M, N52P, N52Q, N52R, N52S, N52T, N52V, N52Y, N57A, N57E, N57F, N57H, N57K, N57L, N57M, N57P, N57Q, N57S, N57T, N57V, N57W, N57Y, Q100A, Q100D, Q100E, Q100G, Q100K, Q100L, Q100M, Q100N, Q100R, Q100P, Q100S, Q100T, or Q100V. In some embodiments, the one or more amino acid modification, e.g. substitution is N52Y/N57Y/F138L/L203P, N52H/N57Y/Q100P, N52S/Y146C/Y152C, N52H/C198R, N52H/C140D/T225A, N52H/C198R/T225A, N52H/K92R, N52H/S99G, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, N52D/S54P, N52K/L208P, N52S/Y152H, N52D/V151A, N52H/I143T, N52S/L80P, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/R61S/Q100R/V110D/L173S, N52H/N57Y/Q100R/V122A, N52H/N57Y/Q100R/F172S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N30D/N52S/L67P/Q100K/D217G/R221K/T225S, N52H/N57Y/Q100R/V110D/A117T/T190S/C198R, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M, C198R, N52H/N57Y/R61C/Y62F/Q100R/V110N/F120S/C198R, N52H/N57Y/Q100R/V110D/H115R/C198R, N52H/N57Y/Q100R/V110D/N144D/F172S/C198R, N52S/H94E/L98F/Q100R, N52S/E90A, N30D/K42E/N52S, N52S/F120S/I143V/I224V, N52H/N57Y/Q100R/V110D/C198R/S212G, N52H/N57Y/Q100R/C198R, N52S/N194D, N52H/N57Y/Q100R/L102R/V110D/H115R/C198R, N52H/N57Y/Q100R/V110D/C198R/S212G, N52H/N57Y/Q100R/C198R, N52S/N194D, N52H/N57Y/Q100R/L102R/V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/N57Y/Q100R/V110D/S132F/M175T, N52D, N52H/N57Y/Q100R/V107I/V110D/I154F/C198R/R221G, N52Q/N207Q, N168Q/N207Q, N52Q/N168Q, N52Q/N84Q, N52Q/N119Q, N52Q/N84Q/N168Q, N52Q/N84Q/N207Q, N52Q/N119Q/N155Q, N52H/N84Q/N119Q, N52H/N84Q/N168Q/N207Q, N52Q/N84Q/N155Q/N168Q, N52Q/N84Q/N119Q/N168Q, N52Q/N84Q/N119Q/N207Q, N52Q/N84Q/N119Q/N155Q, N52Q/N84Q/N119Q/N155Q/N207Q, N52Y/F138L/L203P, N57Y/Q100R/C198R, N57Y/

F138L/L203P, Q100R/F138L, N52H/N57Y/Q100R/H115R/ C198R, N52H/N57Y/Q100R/F172S/C198R, N52H/N57Y/ Q100R/H115R/F172S/C198R, N52H/N57Y/Q100R/L102R/ H115R/F172S/C198R, N52H/V122A/F172S/C198R, N52H/N57Y/Q100R/H115R/F172S/N194D, N52H/N57Y/ H115R/F172S/C198R, N52H/N57Y/Q100R/H115R/ C198R, N52H/N57Y/H115R, N52H/N57Y/Q100R/H115R, N52H/N57Y/Q100R/H115R/F172S/I224V, N52H/N57Y/ Q100R/H115R/F172S, N52H/N57Y/Q100R/F172S, N52H/ Q100R/H115R/I143T/F172S, N52H/N57Y/Q100P/H115R/ F172S, N52Y/N57Y/Q100P/F172S, E16V/N52H/N57Y/ Q100R/V110D/H115R/C198R, E16V/N52H/N57Y/Q100R/ V110D/H115R/Y152C/K156M/F172S/C198R, N52S/E90A/H115R, N30D/K42E N52S/H115R, N30D/K42E/N52S/H115R/C198R/R221I, N30D/K42E/N52S/H115R/C198R, N30D/K42E/N52S/H115R/F172S/N194D, N52S/H115R/F120S/I143V/C198R, N52S/H115R/F172S/C198R, N52H/N57Y/Q100P/C198R, N52H/N57Y/Q100P H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115R/F172S/C198R, N52H/N57Y/Q100R/F172S/C198R, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57H/Q100K, N52R/N57L/Q100S, N52R/N57W/Q100K, N52R/N57W, N52R/N57Y/Q100R, N52C/N57E/Q100S, N52G/N57P/Q100D, N52G/N57V/Q100G, N52G/N57V, N52L/N57V, N52P/N57P, N52P/N57S/Q100G, N52S/N57L/Q100G, N52T/N57K/Q100P, N52V/N57T/Q100L, or N57Q/Q100P.

In some embodiments, the one or more amino acid modifications are selected from among N52Y/N57Y/F138L/L203P, N52H/N57Y/Q100P, N52S/Y146C/Y152C, N52H/C198R, N52H/C140D/T225A, N52H/C198R/T225A, N52H/K92R, N52H/S99G, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, N52D/S54P, N52K/L208P, N52S/Y152H, N52D/V151A, N52H/I143T, N52S/L80P, F120S/Y152H/N201S, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52S/G103E, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/R61S/Q100R/V110D/L173S, N52H/N57Y/Q100R/V122A, N52H/N57Y/Q100R/F172S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N30D/N52S/L67P/Q100K/D217G/R221K/T225S, N52H/N57Y/Q100R/V110D/A117T/T190S/C198R, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M, C198R, N52H/N57Y/R61C/Y62F/Q100R/V110N/F120S/C198R, N52H/N57Y/Q100R/V110D/H115R/C198R, N52H/N57Y/Q100R/V110D/N144D/F172S/C198R, N52S/H94E/L98F/Q100R, N52S/E90A, N30D/K42E/N52S, N52S/F120S/I143V/I224V, N52H/N57Y/Q100R/V110D/C198R/S212G, N52H/N57Y/Q100R/C198R, N52S/N194D, N52H/N57Y/Q100R/L102R/V110D/H115R/C198R, N52H/N57Y/Q100R/V110D/C198R/S212G, N52H/N57Y/Q100R/C198R, N52S/N194D, N52H/N57Y/Q100R/L102R/V110D/H115R/C198R, N52S/S54P, T38P/N52S/N57D, N52H/C140del/T225A, N52H/F78L/Q100R/C198R, N52H/N57Y/R75Q/Q100P/V110D, N52H/N57Y/L74Q/V110D/S192G, N52H/S121G/C198R, N52S/F120S/N227K, N52S/A71T/A117T/T190A/C198R, T43A/N52H/N57Y/L74Q/D89G/V110D/F172S, N52H/N57Y/Q100R/V110D/S132F/M175T, N52H/N57Y/Q100R/V107I/V110D/I154F/C198R/R221G, N52Q/N207Q, N52Q/N168Q, N52Q/N84Q, N52Q/N119Q, N52Q/N84Q/N168Q, N52Q/N84Q/N207Q, N52Q/N119Q/N155Q, N52H/N84Q/N119Q, N52H/N84Q, N52H/N84Q/N168Q/N207Q, N52Q/N84Q/N155Q/N168Q, N52Q/N84Q/N119Q/N168Q, N52Q/N84Q/N119Q/N207Q, N52Q/N84Q/N119Q/N155Q, N52Q/N84Q/N119Q/N155Q/N207Q, N52Y/F138L/L203P, N57Y/Q100R/C198R, N57Y/F138L/L203P, Q100R/F138L, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/V122A/F172S/C198R, N52H/N57Y/Q100R/H115R/F172S/N194D, N52H/N57Y/H115R/F172S/C198R, N52H/N57Y/H115R, N52H/N57Y/Q100R/H115R, N52H/N57Y/Q100R/H115R/F172S/I224V, N52H/N57Y/Q100R/H115R/F172S, N52H/N57Y/Q100R/F172S, N52H/Q100R/H115R/I143T/F172S, N52H/N57Y/Q100P/H115R/F172S, N52Y/N57Y/Q100P/F172S, E16V/N52H/N57Y/Q100R/V110D/H115R/C198R, E16V/N52H/N57Y/Q100R/V110D/H115R/Y152C/K156M/F172S/C198R, N52S/E90A/H115R, N30D/K42E N52S/H115R, N30D/K42E/N52S/H115R/C198R/R221I, N30D/K42E/N52S/H115R/C198R, N30D/K42E/N52S/H115R/F172S/N194D, N52S/H115R/F120S/I143V/C198R, N52S/H115R/F172S/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115R/F172S/C198R, N52H/N57Y/Q100R/F172S/C198R, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/

N57H/Q100R, N52R/N57F/Q100N, N52R/N57F/Q100P, N52R/N57F/Q100R, N52R/N57F/Q100T, N52R/N57H/Q100K, N52R/N57L/Q100S, N52R/N57W/Q100K, N52R/N57W, N52R/N57Y/Q100R, N52C/N57E/Q100S, N52G/N57P/Q100D, N52G/N57V/Q100G, N52G/N57V, N52L/N57V, N52P/N57P, N52P/N57S/Q100G, N52S/N57L/Q100G, N52T/N57K/Q100P, N52V/N57T/Q100L, N57Q/Q100P, or R26S/N52H/N57Y/V110D/T137A/C198R.

In some embodiments, the variant ICOSL polypeptide has one or more amino acid modification, e.g. substitution selected from N52A, N52C, N52D, N52G, N52K, N52L, N52M, N52R, N52T, N52V, N57A, N57E, N57F, N57H, N57K, N57L, N57M, N57P, N57Q, N57S, N57T, N57V, N57W, Q100A, Q100D, Q100G, Q100L, Q100M, Q100N, Q100R, Q100S, Q100T or Q100V. with reference to SEQ ID NO:32. In some embodiments, the one or more amino acid modifications are selected from among N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57H/Q100K, N52R/N57L/Q100S, N52R/N57W/Q100K, N52R/N57W, N52R/N57Y/Q100R, N52C/N57E/Q100S, N52G/N57P/Q100D, N52G/N57V/Q100G, N52G/N57V, N52L/N57V, N52P/N57P, N52P/N57S/Q100G, N52S/N57L/Q100G, N52T/N57K/Q100P, N52V/N57T/Q100L or N57Q/Q100P.

In some embodiments, the variant ICOSL polypeptide has one or more amino acid modification, e.g. substitution selected from N52H/N57Y/Q100R/C198R, N52H/N57Y/Q100R/V122A, N52H/N57Y/Q100R/F172S, N52Y/N57Y/F138L/L203P, V11E/N30D/N52H/N57Y/H94E/L96I/L98F/N194D/V210A/I218T, N52H/N57Y/Q100R/L102R/V110D/H115R/C198R, N52H/N57Y/Q100R, N52H/Q100R, N52H/N57Y/Q100R/V110D/C198R/S212G, N52H/N57Y/Q100R/L102R/V110D/H115R/C198R, E16V/N52H/N57Y/Q100R/V110D/H115R/Y152C/K156M/C198R, N30D/K42E/N52S, N52S/F120S/I143V/I224V, N52S/E90A, N52H/N57Y/V110A/C198R/R221I, N52H/N57Y/Q100P, or N52S/N194D.

In some embodiments, the variant ICOSL polypeptide has one or more amino acid modification, e.g. substitution selected from N52H/N57Y/Q100R/F172S, N52H/Q100R, or N52H/N57Y/Q100R/C198R. In some embodiments, the variant ICOSL polypeptide has one or more amino acid modification, e.g. substitution selected from E16V/N52H/N57Y/Q100R/V110D/H115R/Y152C/K156M/C198R, N52H/N57Y/Q100R, and N52H/N57Y/Q100P.

In some embodiments, the variant ICOSL polypeptide has one or more amino acid modification, e.g. substitution selected from N52H/N57Y/F138L/L203P, N52H/N57Y/Q100P, N52H/K92R, N52H/C140del/T225A, N52H/C198R/T225A, N52H/K92R, N57Y/Q100P, N52Y/N57Y/H129P/C198R, N52H/L161P/C198R, N52K/L208P or N52H/I143T.

In some embodiments, the one or more amino acid modifications are selected from among F120S/Y152H/N201S, E111del, Y33del, N168Q/N207Q, N84Q/N207Q, N155Q/N207Q, N119Q/N168Q, N119Q/N207Q, N119Q/N155Q, N84Q/N119Q, N84Q/N155Q/N168Q, N84Q/N168Q/N207Q, N84Q/N155H/N207Q, N155Q/N168Q/N207Q, N119Q N155Q/N168Q, N119Q/N168Q/N207Q, N84Q/N119Q/N155H/N207Q, N84Q/N119Q/N155Q, N84Q/N119Q/N155Q/N168Q, N84Q/N155Q/N168Q/N207Q, N84Q/N119Q/N155Q/N207Q, N84Q/N119Q/N155Q/N168Q/N207Q or F138L/L203P.

In some embodiments, the variant ICOSL polypeptide exhibits increased binding affinity for binding one of the ectodomains of CD28 or ICOS and exhibits decreased binding affinity for binding to the other of the ectodomains of CD28 or ICOS compared to the reference (e.g., unmodified) or wild-type ICOSL polypeptide, such as comprising the sequence set forth in SEQ ID NO: 32, 196, or 545.

In some embodiments, the variant ICOSL polypeptide exhibits increased binding affinity for ICOS. In some embodiments, the one or more amino acid substitution is at a position corresponding to 16, 30, 42, 52, 54, 57, 75, 90, 92, 100, 102, 110, 113, 115, 120, 122, 133, 138, 143, 146, 152, 156, 158, 172, 194, 198, 203, 208, 221, 224, or 225. In some embodiments, the variant ICOSL contains one or more amino acid substitutions selected from C198R, D158G, E16V, E90A, F120S, F138L, F172S, H115R, H115X, I143T, I143V, I224V, K156M, K42E, K92R, L102R, L203P, L208P, N194D, N30D, N52A, N52D, N52G, N52H, N52K, N52L, N52M, N52Q, N52R, N52S, N52T, N52Y, N57F, N57H, N57K, N57L, N57M, N57P, N57S, N57V, N57W, N57Y, Q100A, Q100D, Q100E, Q100K, Q100M, Q100P, Q100P, Q100R, Q100S, Q100T, Q133H, R221I, R75Q, S54A, S54P, T113E, T225A, V110D, V122A, Y146C, Y152C, or a conservative amino acid substitution thereof. In some embodiments, the variant ICOSL polypeptide has one or more amino acid substitutions selected from N52S, N52H, N52D, N52H/N57Y/Q100P, N52S/Y146C/Y152C, N52H/C198R, N52H/C198R/T225A, N52H/K92R, N57Y, N52S/C198R, N52S/T113E, S54A, N52D/S54P, N52K/L208P, N52H/I143T, N52S/R75Q/L203P, N52S/D158G, N52D/Q133H, N52H/N57Y/Q100R/V122A, N52H/N57Y/Q100R/F172S, N52H/N57Y/Q100R, N52S/N194D, N52H/N57Y/Q100R/L102R/V110D/H115R/C198R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115X/F172S/C198R, N52H/Q100R/H115R/F172S/C198R, N52H/N57Y/Q100R/H115R/F172S/C198R, N52H/N57Y/Q100R/H115R/F172S, N52H/N57Y/Q100R/H115R/F172S/C198R, Q100R, N52Y/F138L/L203P, N57Y/Q100R/C198R, N57Y/F138L/L203P, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R, H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T F172S, N52H/N57Y/Q100R/H115R/F172S, E16V/N52H/N57Y/Q100R/V110D/H115R/C198R, N52S/E90A/H115R, N30D/K42E/N52S/H115R/C198R/R221I, N30D/K42E/N52S/H115R/C198R, N30D/K42E/N52S/H115R/F172S/N194D, N30D/K42E/N52S/H115R, N52S/E90A/H115R, N30D/K42E/N52S/H115R, N52A/

N57H/Q100S, N52A/N57Y/Q100A, N52D/Q100S, N52G/ Q100A, N52M/N57H/Q100S, N52M/N57W/Q100P, N52Q/ N57S/Q100A, N52R/N57L/Q100A, N52S/N57H/Q100E, N52S/N57L/Q100S, N52S/N57M/Q100S, N52S/N57Y/ Q100M, N52T/N57H/Q100S, N52R/N57F/Q100P, N52R/ N57F/Q100T, N52R/N57W/Q100K, N52R/N57W, N52G/ N57P/Q100D, N52G/N57V/Q100G, N52G/N57V, N52L/ N57V, N52S/N57L/Q100G or N52T/N57K/Q100P.

In some embodiments, the variant ICOSL polypeptide exhibits increased binding affinity for ICOS and exhibits decreased binding affinity for CD28. In some embodiments, the one or more further amino acid substitution is at a position corresponding to 52, 57, 80 100, 130, 152, 161 or 198. In some embodiments, the variant ICOSL contains one or more amino acid substitutions selected from N52S, N52H, N52Y, N52H, N57Y, L80P, Q100P Q100R, Q100K, V110D, S130G, Y152C, L161P, L161M, C198R, R221G, or a conservative amino acid substitution thereof. In some embodiments, the variant ICOSL polypeptide has one or more amino acid substitutions selected from N57Y/Q100P, N52S/S130G/Y152C, N52S/Y152C, N52Y/N57Y/Y152C, N52H/L161P/C198R, N52H/L161P/C198R, N52S/L80P, A20V/N52H/N57Y/Q100R/S109G, N52H/N57Y/R61S/ Q100R/V110D/L173S, N52H/N57Y/Q100R/V107I/ V110D/S132F/I154F/C198R/R221G, Q37R/N52H/N57Y/ Q100R/V110N/S142F/C198R/D217V/R221G, N52H/ N57Y/Q100R/V110D/C198R, F27S/N52H/N57Y/V110N, S18R/N52S/F93L/I143V/R221G, A20T/N52D/Y146C/ Q164L, N52H/N57Y/H94E/L96I/F120I/S126T/W153R/ I218N, N52H/N57Y/Q100R/V110D/F172S/C198R, S25G/ F27C/N52H/N57Y/Q100R/V110D/E135K/L173S/C198R, M10I/S13G/N52H/N57Y/D77G/V110A/H129P/I143V/ F172S/V193M/C198R.

In some embodiments, the variant ICOSL polypeptide exhibits increased binding affinity for CD28. In some embodiments, the one or more amino acid substitution is at a position corresponding to 10, 11, 13, 16, 18, 20, 25, 27, 30, 36, 40, 41, 42, 52, 54, 57, 63, 70, 71, 72, 74, 77, 80, 81, 84, 88, 89, 90, 91, 92, 93, 94, 96, 98, 99, 100, 102, 107, 109, 110, 113, 114, 115, 117, 118, 119, 120, 121, 122, 126, 127, 129, 130, 132, 133, 135, 138, 139, 140, 143, 144, 146, 152, 153, 154, 155, 156, 158, 161, 166, 168, 169, 172, 173, 178, 190, 192, 193, 194, 198, 199, 201, 203, 207, 208, 209, 212, 218, 221, 224, 225, or 227.

In some embodiments, the variant ICOSL contains one or more amino acid substitutions selected from A117T, A20V, A71T, A91G, A91G, AE88D, C140del, C198R, D158G, D77G, D90K, E117G, E135K, E16V, E81A, E88D, E90A, F120I, F120S, F138L, F172S, F27C, F92Y, G72R, H115R, H115X, H129P, H94E, I118V, I127T, I143T, I143V, I154F, I218N, I218T, I224V, K156M, K169E, K36G, K42E, K89R, K92R, K93R, L102R, L161P, L166Q, L173S, L203F, L203P, L208P, L209P, L40M, L70Q, L70R, L74Q, L80P, L96I, L98F, M10I, M10V, N115Q, N119Q, N122S, N144D, N155X, N168Q, N168X, N178S, N194D, N207Q, N207X, N227K, N25S, N30D, N52A, N52D, N52G, N52H, N52K, N52L, N52M, N52Q, N52R, N52S, N52T, N52V, N52Y, N57A, N57F, N57H, N57L, N57M, N57S, N57V, N57W, N57Y, N63S, N84Q, Q100A, Q100E, Q100G, Q100K, Q100M, Q100N, Q100P, Q100R, Q100S, Q100T, Q100V, Q133H, R221G, R221I, S109G, S109N, S114T, S121G, S126R, S126T, S130G, S132F, S13G, S18R, S192G, S212G, S25G, S54A, S54P, S99G, T113E, T120S, T130A, T139S, T190A, T199S, T225A, T41I, T107I, V110A, V110D, V11E, V122A, V122M, V193M, V210A, W153R, Y146C, Y152C, Y152H, or a conservative amino acid substitution thereof. In some embodiments, the variant ICOSL polypeptide has one or more amino acid substitutions selected from N52S, N52H, N52D, N52Y/N57Y/ F138L/L203P, N52H/N57Y/Q100P, N52S/Y146C/Y152C, N52H/C198R, N52H/C140del/T225A, N52H/C198R/ T225A, N52H/K92R, N52H/S99G, N57Y, N57Y/Q100P, N52S/S130G/Y152C, N52S/Y152C, N52S/C198R, N52Y/ N57Y/Y152C, N52Y/N57Y/H129P/C198R, N52H/L161P/ C198R, N52S/T113E, S54A, N52D/S54P, N52K/L208P, N52S/Y152H, N52H/I143T, N52S/L80P, N52S/D158G, N52D/Q133H, L70Q/A91G/N144D, L70Q/A91G/E117G/ I118V/T120S/T130A, L70R/A91G/I118V/T120S/T130A/ T199S, L70Q/E81A/A91G/I118V/T120S/I127T/T130A, N63S/L70Q/A91G/S114T/I118V/T120S/T130A, T41I/ A91G, E88D/K89R/D90K/A91G/F92Y/K93R/N122S/ N178S, E88D/K89R/D90K/A91G/F92Y/K93R, AE88D/ K89R/D90K/A91G/F92Y/K93R, K36G/L40M, N52H/ N57Y/Q100R/V122A, N52H/N57Y/Q100R/F172S, N52H/ N57Y/Q100R, N52S/F120S/N227K, N52S/N194D, N52S/ F120S, N52S/G72R, N52S/A71T/A117T/T190A/C198R, N52H/N57Y/Q100R/V107I/V110D/S132F/I154F/C198R/ R221G, E16V/N52H/N57Y/Q100R/V110D/H115R/ Y152C/K156M/C198R, N52H/N57Y/Q100R/V110D/ C198R, V11E/N30D/N52H/N57Y/H94E/L96I/L98F/ N194D/V210A/I218T, N52S/H94E/L96I/V122M, N52H/ N57Y/H94E/L96I/F120I/S126T/W153R/I218N, M10V/ S18R/N30D/N52S/S126R/T139S/L203F, S25G/N30D/ N52S/F120S/N227K, N52H/N57Y/Q100R/V110D/F172S/ C198R, S25G/F27C/N52H/N57Y/Q100R/V110D/E135K/ L173S/C198R, N52H/N57Y/V110A/C198R/R221I, M10I/ S13G/N52H/N57Y/D77G/V110A/H129P/I143V/F172S/ V193M, C198R, N52H/N57Y/Q100R/L102R/V110D/ H115R/C198R, N52H/N57Y/Q100R/V110D/N144D/ F172S/C198R, N52S/H94E/L98F/Q100R, N52S/E90A, N52S/F120S/I143V/I224V, N52H/N57Y/Q100R/F172S/ C198R, N52H/N57Y/Q100R/H115R/F172S/C198R, N52Y/ N57Y/Q100P/F172S, E16V/N52H/N57Y/Q100R/V110D/ H115R/Y152C/K156M/F172S/C198R, N52S/H115R/ F120S/I143V/C198R, N52H/N57Y/Q100P/C198R, N52H/ N57Y/Q100P/H115R/F172S/C198R, N52H/N57Y/Q100P/ F172S/C198R, N52H/N57Y/Q100P/H115R, N52H/N57Y/ Q100P/H115R/C198R, N52H/Q100R/C198R, N52H/ Q100R/H115R/F172S, N52H/Q100R/H115X/F172S/ C198R, N52H/Q100R/H115R/F172S/C198R, N52H/N57Y/ Q100R/F172S/C198R, N52H/N57Y/Q100R/H115R/F172S/ C198R, N52H/N57Y/Q100R/H115R/F172S, N52H/N57Y/ Q100R/H115R/F172S/C198R, N52S/H94E/L96I/S109N/ L166Q/N52H/N57Y/Q100R/C198R, N52H/N57Y/L74Q/ V110D/S192G, N52H/Q100R, N52H/S121G/C198R, A20V/N52H/N57Y/Q100R/S109G, N52H/N57Y/Q100P/ C198R, N52H/N57Y/Q100R/V110D/C198R/S212G, L70Q/A91G/I118A/T120S/T130A/K169E, Q100R, N52Y/ F138L/L203P, N57Y/Q100R/C198R, N57Y/F138L/L203P, N52H, N57Y, N57Y/Q100P, N52H/N57Y/Q100R/H115R, N52H/N57Y/Q100R/F172S, N52H/N57Y/Q100R/H115R/ F172S/I224V, N52H/N57Y/Q100R/H115R/F172S, N52H/ N57Y/Q100R/H115R/C198R, N52H/N57Y/Q100R/F172S/ C198R, N52H/N57Y/Q100R/H115R/F172S/C198R, N52H/ N57Y/Q100R/H115R/I143V/F172S/C198R, N52H/N57Y/ Q100R/L102R H115R/F172S/C198R, N52H/N57Y/ Q100R/H115R F172S/N194D, N52H/N57Y/H115R/F172S/ C198R, N52H/N57Y/Q100R/H115R/C198R, N52H/N57Y/ H115R, N52H/Q100R/H115R/I143T F172S, N52H/N57Y/ Q100P/H115R/F172S, E16V/N52H/N57Y/Q100R/V110D/ H115R/C198R, N30D/K42E/N52S/H115R/C198R R221I, N52S/E90A/H115R, N30D/K42E/N52S/H115R, N52S/ H115R/F172S/C198R, N119Q, N207Q, N52Q/N207X, N168X/N207X, N52Q/N168Q, N84Q/N207Q, N119Q N155X, N52Q/N119Q, N52Q/N84Q/N207Q, N119Q/ N155Q/N168Q, N52H/N84Q/N119Q, N52Q/N84Q/ N155X/N168X, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/ N57W/Q100P, N52Q/N57F, N52Q/N57S/Q100A, N52R/ N57L/Q100A, N52R/N57Y/Q100P, N52R/N57Y/Q100S, N52S/N57A/Q100A, N52S/N57H/Q100E, N52S/N57L/ Q100S, N52S/N57M/Q100S, N52S/N57Y/Q100S, N52S/ N57Y/Q100M, N52S/N57Y/Q100V, N52T/N57H/Q100S, N52T/N57H/Q100A, N52T/N57Y/Q100A, N52V/N57L/ Q100A, N52H/N57Y/Q100K, N52K/N57Y/Q100R, N52L/ N57H/Q100R, N52R/N57F/Q100N, N52R/N57F/Q100P, N52R/N57F/Q100R, N52R/N57F/Q100T, N52R/N57L/ Q100S, N52R/N57W/Q100K, N52R/N57W, N52G/N57V, N52L/N57V, N52S/N57L/Q100G, or N52T/N57K/Q100P.

In some embodiments, the variant ICOSL polypeptide exhibits increased binding affinity for CD28 and exhibits decreased binding affinity for ICOS. In some embodiments, the one or more amino acid substitution is at a position corresponding to 52, 75 or 203. In some embodiments, the variant ICOSL contains one or more amino acid substitution selected from N52S, R75Q, L203F, or L203P. In some embodiments, the variant ICOSL polypeptide has amino acid substitutions N52S/R75Q/L203P.

In some embodiments, the variant ICOSL polypeptide has one or more amino acid modification, e.g. substitution in an reference ICOSL or specific binding fragment there of corresponding to position(s) 16, 30, 42, 52, 57, 90, 100, 102, 110, 115, 120, 122, 138, 143, 152, 156, 172, 194, 198, 203, 221, or 224 with reference to numbering of SEQ ID NO: 32. In some embodiments, the variant ICOSL polypeptide has one or more amino acid modification, e.g. substitution selected from E16V, N30D, K42E, N52H, N52Y, N52S, N57Y, E90A, Q100R, Q100P, L102R, V110D, H115R, F120S, V122A, F138L, I143V, I143T, H152C, K156M, F172S, N194D, C198R, L203P, R221I, or I224V. In some embodiments, the variant ICOSL polypeptide has one or more amino acid modification, e.g. substitution in an reference ICOSL or specific binding fragment there of corresponding to position(s) 115, 172, or 198 with reference to numbering of SEQ ID NO:32. In some embodiments, the variant ICOSL polypeptide has one or more amino acid modification, e.g. substitution selected from H115R, F172S or C198R. In some embodiments, the one or more amino acid modification, e.g. substitution is N52H/N57Y/Q100R/ H115R/C198R, N52H/N57Y/Q100R/F172S/C198R, N52H/ N57Y/Q100R/H115R/F172S/C198R, N52H/N57Y/Q100R/ H115R/I143V/F172S/C198R, N52H/N57Y/Q100R/L102R/ H115R/F172S/C198R, N52H/V122A/F172S/C198R, N52H/N57Y/Q100R/H115R/F172S/N194D, N52H/N57Y/ H115R/F172S/C198R, N52H/N57Y/Q100R/H115R/ C198R, N52H/N57Y/H115R, N52H/N57Y/Q100R/H115R, N52H/N57Y/Q100R/H115R/F172S/I224V, N52H/N57Y/ Q100R/H115R/F172S, N52H/N57Y/Q100R/F172S, N52H/ Q100R/H115R/I143T/F172S, N52H/N57Y/Q100P/H115R/ F172S, N52Y/N57Y/Q100P/F172S, E16V/N52H/N57Y/ Q100R/V110D/H115R/C198R, E16V/N52H/N57Y/Q100R/ V110D/H115R/Y152C/K156M/F172S/C198R, N52S/ E90A/H115R, N30D/K42E N52S/H115R, N30D/K42E/ N52S/H115R/C198R/R221I, N30D/K42E/N52S/H115R/ C198R, N30D/K42E/N52S/H115R/F172S/N194D, N52S/ H115R/F120S/I143V/C198R, N52S/H115R/F172S/C198R, N52H/N57Y/Q100P/C198R, N52H/N57Y/Q100P H115R/ F172S/C198R, N52H/N57Y/Q100P/F172S/C198R, N52H/ N57Y/Q100P/H115R, N52H/N57Y/Q100P/H115R/C198R, N52H/Q100R/C198R, N52H/Q100R/H115R/F172S, N52H/ Q100R/F172S/C198R, N52H/Q100R/H115R/F172S/ C198R or N52H/N57Y/Q100R/F172S/C198R. In some embodiments, the variant ICOSL polypeptides exhibit potentially enhanced protein solubility or enhanced protein expression ('solubility mutations') compared to the reference (e.g., unmodified) or wild-type ICOSL polypeptide.

In some embodiments, the variant ICOSL polypeptide comprises any of the extracellular domain (ECD) sequences set forth in SEQ ID NOS: 435-470. In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) set forth in SEQ ID NOS: 435-470 and contains the amino acid modification(s), e.g. substitution(s) not present in the reference (e.g., unmodified) or wild-type ICOSL. In some embodiments, the variant ICOSL polypeptide comprises a specific binding fragment of any of the extracellular domain (ECD) sequences set forth in SEQ ID NOS: 435-470 and contains the amino acid modification(s), e.g. substitution (s) not present in the reference (e.g., unmodified) or wild-type ICOSL.

In some embodiments, the variant ICOSL polypeptide exhibits increased binding affinity for CD28 and exhibits increased binding affinity for ICOS. In some embodiments, the one or more amino acid substitution is at a position corresponding to 16, 30, 42, 52, 54, 57, 90, 92, 100, 102, 110, 113, 115, 120, 122, 133, 138, 143, 146, 152, 156, 158, 172, 194, 198, 203, 208, 212, 224, or 225. In some embodiments, the variant ICOSL contains one or more amino acid substitutions selected from C198R, D158G, E16V, E90A, F120S, F138L, F172S, H115R, I143V, I224V, K156M, K42E, K92R, L102R, L203P, L208P, N194D, N30D, N52A, N52D, N52G, N52H, N52K, N52L, N52M, N52Q, N52R, N52S, N52T, N52Y, N57F, N57H, N57L, N57M, N57S, N57V, N57W, N57Y, Q100A, Q100E, Q100G, Q100K, Q100M, Q100P, Q100R, Q100S, Q133H, S212G, S54A, S54P, T113E, T225A, V110D, V122A, Y146C, Y152C, or a conservative amino acid substitution thereof. In some embodiments, the variant ICOSL polypeptide has one or more amino acid substitutions selected from N52A/N57Y/ Q100A, N52D/Q100S, N52G/Q100A, N52M/N57H/ Q100S, N52M/N57W/Q100P, N52Q/N57S/Q100A, N52R/ N57L/Q100A, N52S/N57H/Q100E, N52S/N57L/Q100S, N52S/N57M/Q100S, N52S/N57Y/Q100M, N52T/N57H/ Q100S, N52R/N57F/Q100P, N52R/N57F/Q100T, N52R/ N57W/Q100K, N52R/N57W, N52G/N57V, N52L/N57V, N52S/N57L/Q100G, N52T/N57K/Q100P, N52S, N52H, N52D, N52Y/N57Y/F138L/L203P, N52H/N57Y/Q100P, N52S/Y146C/Y152C, N52H/C198R, N52H/C198R/T225A, N52H/K92R, N57Y, N52S/C198R, N52S/T113E, S54A, N52D/S54P, N52K/L208P, N52H/I143T, N52S/D158G, N52D/Q133H, N52H/N57Y/Q100R/V110D/C198R/ S212G, N52H/N57Y/Q100R/V122A, N52H/N57Y/Q100R/ F172S, N52H/N57Y/Q100R, N52S/N194D, N52H/N57Y/ Q100R/L102R/V110D/H115R/C198R, N52S/E90A, N52S/ F120S/I143V/I224V, N52H/N57Y/Q100R/F172S/C198R, N52H/N57Y/Q100R/H115R/F172S/C198R, N52Y/N57Y/ Q100P/F172S, E16V/N52H/N57Y/Q100R/V110D/H115R/ Y152C/K156M/F172S/C198R, N52S/H115R/F120S/ I143V/C198R, N52H/N57Y/Q100P/C198R, N52H/N57Y/ Q100P/H115R/F172S/C198R, N52H/N57Y/Q100P/F172S/ C198R, N52H/N57Y/Q100P/H115R, N52H/N57Y/Q100P/ H115R/C198R, N52H/Q100R/C198R, N52H/Q100R/ H115R/F172S, N52H/Q100R/H115X/F172S/C198R, N52H/Q100R/H115R/F172S/C198R, N52H/N57Y/Q100R/

H115R/F172S/C198R, N52H/N57Y/Q100R/H115R/F172S, N52H/N57Y/Q100R/H115R/F172S/C198R, Q100R, N52Y/F138L/L203P, N57Y/Q100R/C198R, N57Y/F138L/L203P, N52H, N57Y, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T/F172S, N52H/N57Y/Q100P/H115R/F172S, E16V/N52H/N57Y/Q100R/V110D/H115R/C198R, N52S/E90A/H115R, N52S/E90A/H115R, N30D/K42E/N52S/H115R.

In some embodiments, the variant ICOSL polypeptide has one or more amino acid modification, e.g. substitution in a reference ICOSL or specific binding fragment there of corresponding to position(s) 52, 57, 100, 138, 198, or 203 with reference to numbering of SEQ ID NO:32. In some embodiments, the variant ICOSL polypeptide has one or more amino acid modification, e.g. substitution selected from N52H, N52Y, N57Y, Q100R, Q100P, F138L, C198R, or L203P. In some embodiments, the one or more amino acid modification, e.g. substitution is Q100R, F138L/L203P, N52Y/F138L/L203P, N57Y/Q100R/C198R, N57Y/F138L/L203P, N52H, N57Y, N57Y/Q100P, Q100R/F138L, or L203P.

In some embodiments, the variant ICOSL polypeptide comprises any of the extracellular domain (ECD) sequences set forth in SEQ ID NOS: 427-433. In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) set forth in SEQ ID NOS: 427-433 and contains the amino acid modification(s), e.g. substitution(s) not present in the reference (e.g., unmodified) or wild-type ICOSL. In some embodiments, the variant ICOSL polypeptide comprises a specific binding fragment of any of the extracellular domain (ECD) sequences set forth in SEQ ID NOS: 427-433 and contains the amino acid modification(s), e.g. substitution (s) not present in the reference (e.g., unmodified) or wild-type ICOSL. In some embodiments, the variant ICOSL polypeptide comprises the IgV sequence set forth in SEQ ID NO: 434. In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to the IgV sequence set forth in SEQ ID NO: 434 and contains the amino acid modification(s), e.g. substitution(s) not present in the reference (e.g., unmodified) or wild-type ICOSL. In some embodiments, the variant ICOSL polypeptide comprises a specific binding fragment of the IgV sequence set forth in SEQ ID NO: 434 and contains the amino acid substitution(s) not present in the reference (e.g., unmodified) or wild-type ICOSL.

In some embodiments, the variant ICOSL polypeptide has one or more amino acid modification, e.g. substitution in a reference ICOSL or specific binding fragment there of corresponding to position(s) 52, 84, 91, 119, 155, 168, 207 with reference to numbering of SEQ ID NO:32. In some embodiments, the variant ICOSL polypeptide has one or more amino acid modification, e.g. substitution selected from A91S, N52H, N52Q, N84Q, N119Q, N155H, N155Q, N168Q, N207Q. In some embodiments, the one or more amino acid modification, e.g. substitution is N84Q, N119Q, N168Q, N207Q, N52Q, N52Q/N207Q, N168Q/N207Q, N52Q/N168Q, N84Q/N207Q, N155Q/N207Q, N119Q/N168Q, N119Q/N207Q, N119Q/N155Q, N52Q/N84Q, N52Q/N119Q, N84Q/N119Q, N52Q/N84Q/N168Q, N52Q/N84Q/N207Q, N84Q/N155Q/N168Q, N84Q/N168Q/N207Q, N84Q/N155H/N207Q, N155Q/N168Q/N207Q, N119Q N155Q/N168Q, N119Q/N168Q/N207Q, N84Q/N119Q/N207Q, N119Q/N155H/N207Q, N84Q/N119Q/N155Q, N52Q/N119Q/N155Q, N52H/N84Q/N119Q, N52H/N84Q, N52H/N84Q/N168Q, N52H/N84Q/N207Q, N52H/N84Q/N168Q/N207Q, N52Q/N84Q/N155Q, N52Q/N84Q/N168Q, N52Q/N84Q/N155Q/N168Q, N52Q/N84Q/N119Q/N168Q, N84Q/N119Q/N155Q/N168Q, N84Q/N155Q/N168Q/N207Q, N84Q/N119Q/N155Q/N207Q, N52Q/N84Q/N119Q/N207Q, N52Q/N84Q/N119Q/N155Q, N52Q/N84Q/N119Q/N155Q/N207Q, N84Q/N119Q/N155Q/N168Q/N207Q or A91S/N119Q/N168Q/N207Q. In some embodiments, the variant ICOSL polypeptides exhibit potentially reduced glycosylation compared to the reference (e.g., unmodified) or wild-type ICOSL polypeptide.

In some embodiments, the variant ICOSL polypeptide comprises any of the extracellular domain (ECD) sequences set forth in SEQ ID NOS: 387-424, 427-433, 435-470. In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the extracellular domain (ECD) set forth in SEQ ID NOS: 387-424, 427-433, 435-470 and contains the amino acid modification(s), e.g. substitution(s) not present in the reference (e.g., unmodified) or wild-type ICOSL. In some embodiments, the variant ICOSL polypeptide comprises a specific binding fragment of any of the extracellular domain (ECD) sequences set forth in SEQ ID NOS: 387-424, 427-433, 435-470 and contains the amino acid modification(s), e.g. substitution (s) not present in the reference (e.g., unmodified) or wild-type ICOSL. In some embodiments, the variant ICOSL polypeptide comprises any of the IgV sequences set forth in SEQ ID NOS: 425-426. In some embodiments, the variant ICOSL polypeptide comprises a polypeptide sequence that exhibits at least 90% identity, at least 91% identity, at least 92% identity, at least 93% identity, at least 94% identity, at least 95% identity, such as at least 96% identity, 97% identity, 98% identity, or 99% identity to any of the IgV sequences set forth in SEQ ID NO: 425-426 and contains the amino acid modification(s), e.g. substitution(s) not present in the reference (e.g., unmodified) or wild-type ICOSL. In some embodiments, the variant ICOSL polypeptide comprises a specific binding fragment of any of the IgV sequences set forth in SEQ ID NO: 425-426 and contains the amino acid substitution(s) not present in the reference (e.g., unmodified) or wild-type ICOSL.

III. FORMAT OF VARIANT POLYPEPTIDES

The immunomodulatory polypeptide comprising a variant ICOSL provided herein can be formatted in a variety of ways, including as a soluble protein, a membrane bound protein, secreted protein, conjugate or fusion or for expression by an engineered cell or infectious agent as described elsewhere herein. In some aspects, both immunomodulatory polypeptides comprising one or more vIgD of ICOSL or immunomodulatory polypeptides comprising multiple IgSF domains can be formatted in a variety of ways.

In some embodiments, the particular format can be chosen for the desired therapeutic application. In some cases, an immunomodulatory polypeptide comprising a variant ICOSL polypeptide is provided in a format to antagonize or block activity of its cognate binding partner, e.g. CD28. In some embodiments, antagonism of CD28 may be useful to treat inflammation or autoimmunity. In some cases, an immunomodulatory polypeptide comprising a variant ICOSL polypeptide is provided in a format to agonize or stimulate activity of its cognate binding partner, e.g. CD28. In some embodiments, agonism of CD28 may be useful for treating oncology indications. A skilled artisan can readily determine the activity of a particular format, such as for antagonizing or agonizing one or more specific cognate binding partner. Exemplary methods for assessing such activities are provided herein, including in the examples.

In some embodiments, a soluble immunomodulatory polypeptide, such as a variant ICOSL containing a vIgD, can be encapsulated within a liposome which itself can be conjugated to any one of or any combination of the provided conjugates (e.g., a targeting moiety). In some embodiments, the soluble or membrane bound immunomodulatory polypeptides of the invention are deglycosylated. In more specific embodiments, the variant ICOSL sequence is deglycosylated. In even more specific embodiments, the IgV and/or IgC (e.g. IgC2) domain or domains of the variant ICOSL is deglycosylated.

Figure 13A:
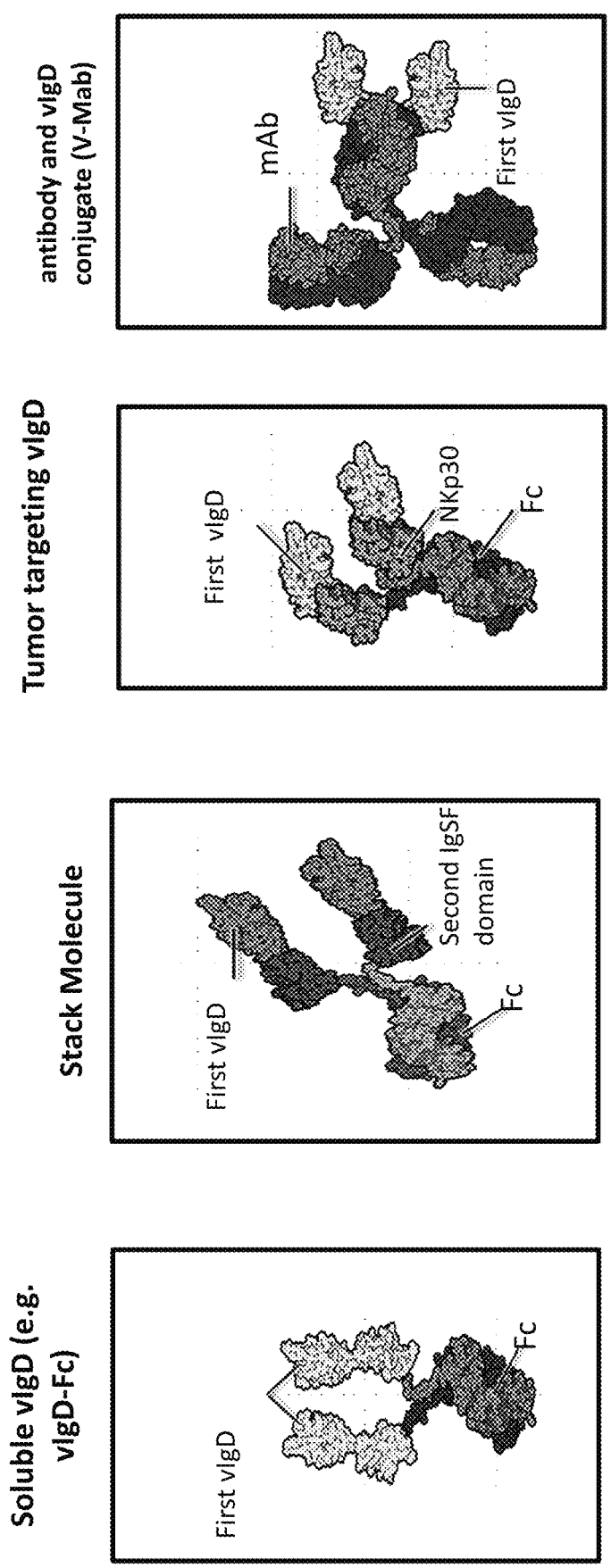
FIGS. 13A-13C depicts various formats of the provided variant IgSF domain molecules.
Figure 13B:
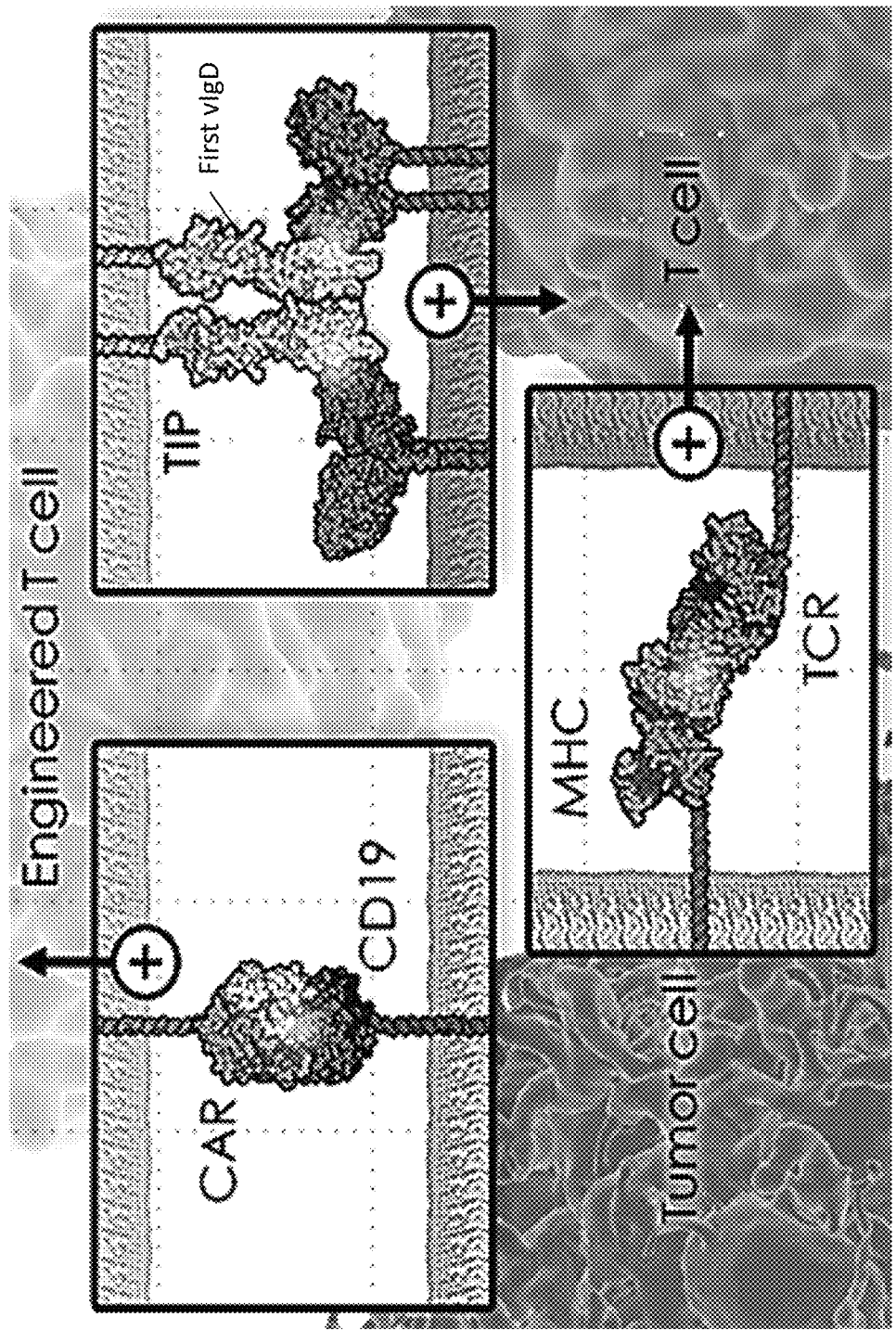
Figure 13C:
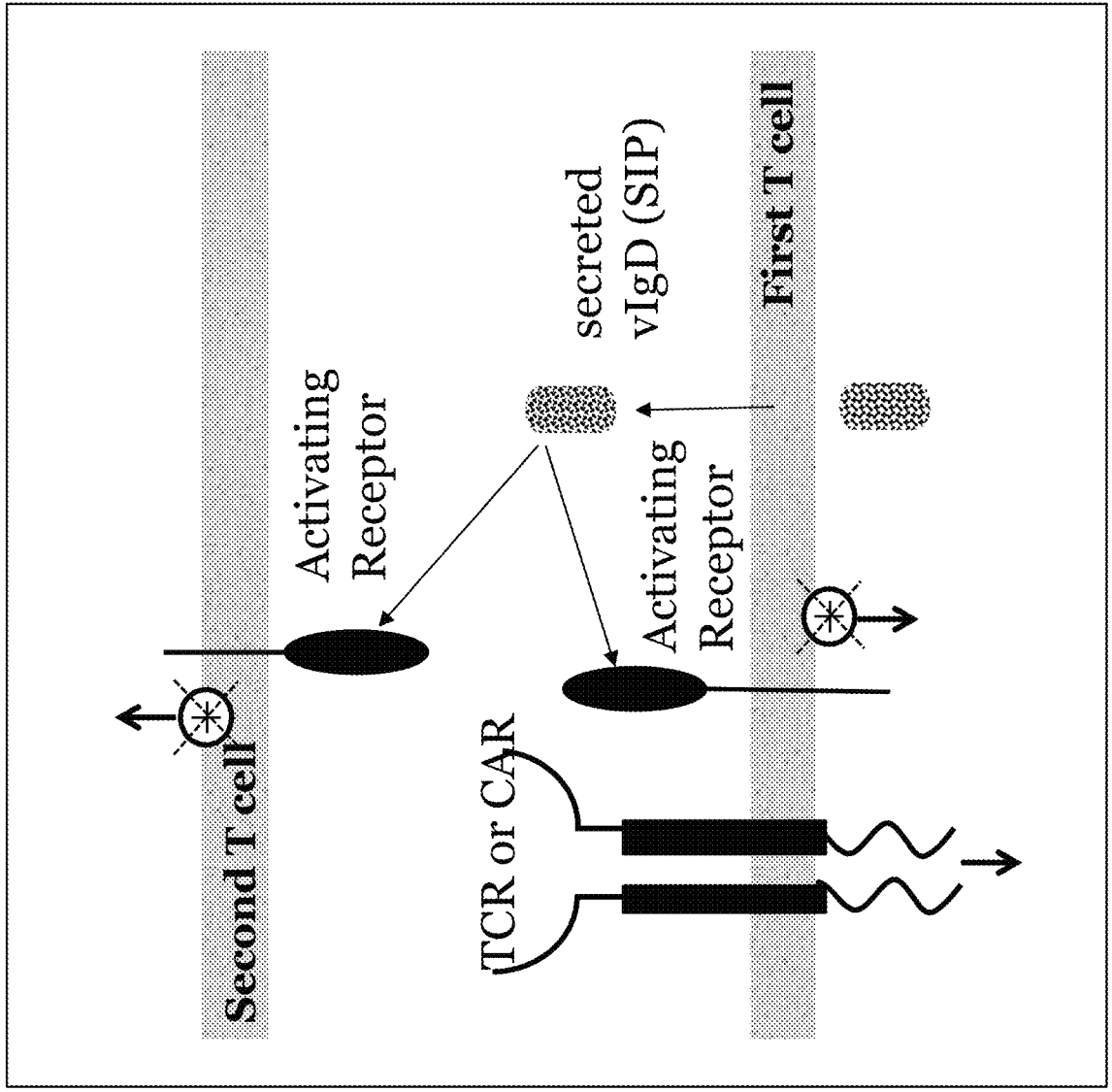
Figure 14:
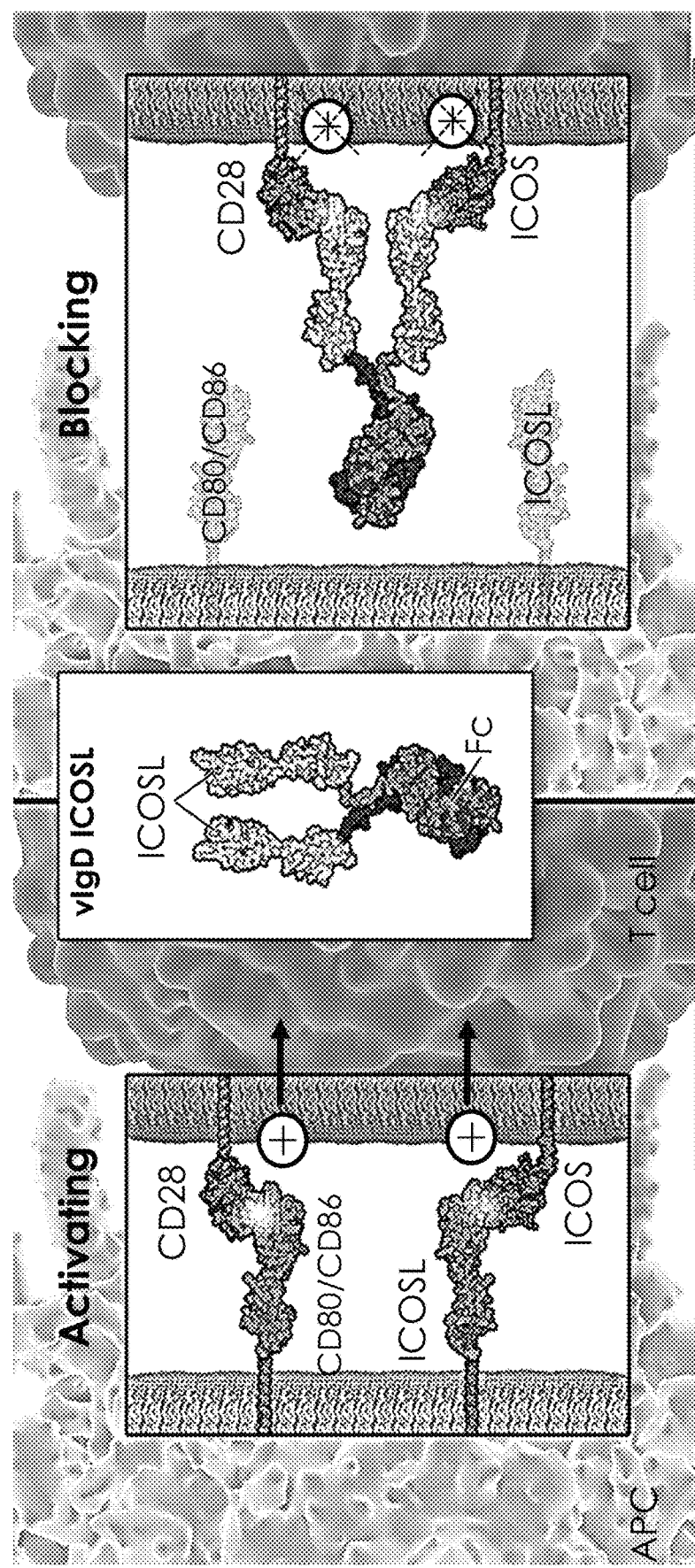
FIG. 14 depicts an exemplary schematic of the activity of a variant IgSF domain (vIgD) fused to an Fc (vIgD-Fc) in which the vIgD is a variant of an IgSF domain of ICOSL. As shown, a soluble vIgD of ICOSL interacts with its cognate binding partners to block interactions of CD80 (B7-1)/CD86 (B7-2) or ICOSL with CD28 or ICOS, respectively, thereby blocking costimulation by the CD28 and/or ICOS costimulatory receptors.
Figure 15:
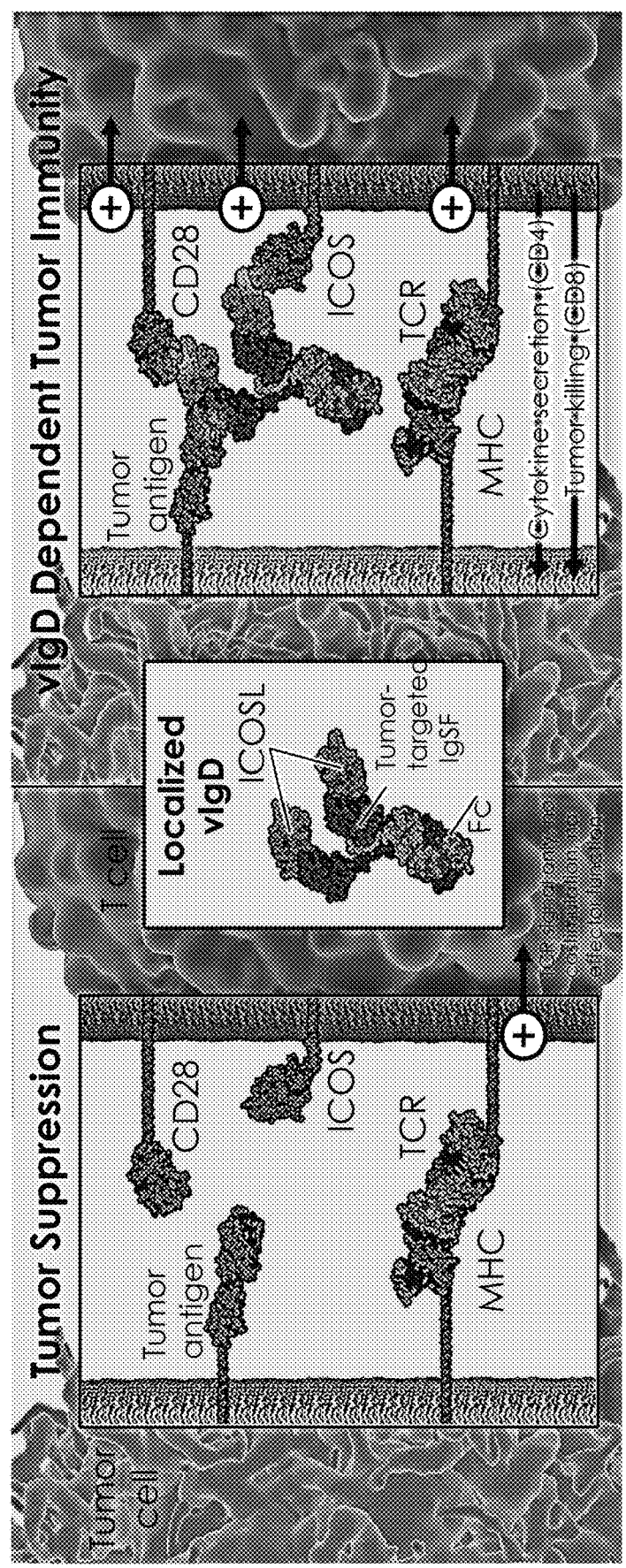
FIG. 15 depicts an exemplary schematic of a stack molecule for localizing the variant IgSF domain (vIgD) to a tumor cell. In this format, the stack molecule contains a first variant IgSF domain (first vIgD) and a second IgSF domain (e.g. a second vIgD) in which the second IgSF domain (e.g a second vIgD) is a tumor-targeted IgSF domain that binds to a tumor antigen. An exemplary tumor-targeted IgSF domain is an IgSF domain of NKp30, which binds to the tumor antigen B7-H6. In this depiction, the vIgD is a variant of an IgSF domain of ICOSL. As shown, binding of tumor-targeted IgSF domain to the surface of the tumor cell localizes the first vIgD on the tumor cell surface where it can interact with one or more of its cognate binding partners (e.g. CD28 or ICOS) expressed on the surface of an adjacent immune cell (e.g. T cell) to stimulate the costimulatory receptor.

Non-limiting examples of provided formats are described in FIGS. 13A-13C and further described below.

A. Soluble Polypeptides

In some aspects, provided are immunomodulatory polypeptides comprising a vIgD of ICOSL. In some embodiments, the immunomodulatory protein containing a variant ICOSL polypeptide is a soluble protein. Those of skill will appreciate that cell surface proteins typically have an intracellular, transmembrane, and extracellular domain (ECD) and that a soluble form of such proteins can be made using the extracellular domain or an immunologically active subsequence thereof. Thus, in some embodiments, the immunomodulatory protein containing a variant ICOSL polypeptide lacks a transmembrane domain or a portion of the transmembrane domain. In some embodiments, the immunomodulatory protein containing a variant ICOSL lacks the intracellular (cytoplasmic) domain or a portion of the intracellular domain. In some embodiments, the immunomodulatory protein containing the variant ICOSL polypeptide only contains the vIgD portion containing the ECD domain or a portion thereof containing an IgV domain and/or IgC (e.g. IgC2) domain or domains or specific binding fragments thereof containing the amino acid modification(s).

In some embodiments, an immunomodulatory polypeptide comprising a variant ICOSL can include one or more variant ICOSL polypeptides. In some aspects, one or more additional IgSF domain, such as one or more additional vIgD, may be linked to a vIgD of ICOSL as provided herein. In some aspects, both immunomodulatory polypeptides comprising one or more vIgD of ICOSL or immunomodulatory polypeptides comprising multiple IgSF domains can be formatted in a variety of ways, such as described in subsection C of Section III.

In some embodiments, an immunomodulatory polypeptide comprising a variant ICOSL can include one or more variant ICOSL polypeptides of the invention. In some embodiments a polypeptide of the invention will comprise exactly 1, 2, 3, 4, 5 variant ICOSL sequences. In some embodiments, at least two of the variant ICOSL sequences are identical variant ICOSL sequences.

In some embodiments, the provided immunomodulatory polypeptide comprises two or more vIgD sequences of ICOSL. Multiple variant ICOSL polypeptides within the polypeptide chain can be identical (i.e., the same species) to each other or be non-identical (i.e., different species) variant ICOSL sequences. In addition to single polypeptide chain embodiments, in some embodiments two, three, four, or more of the polypeptides of the invention can be covalently or non-covalently attached to each other. Thus, monomeric, dimeric, and higher order (e.g., 3, 4, 5, or more) multimeric proteins are provided herein. For example, in some embodiments exactly two polypeptides of the invention can be covalently or non-covalently attached to each other to form a dimer. In some embodiments, attachment is made via interchain cysteine disulfide bonds. Compositions comprising two or more polypeptides of the invention can be of an identical species or substantially identical species of polypeptide (e.g., a homodimer) or of non-identical species of polypeptides (e.g., a heterodimer). A composition having a plurality of linked polypeptides of the invention can, as noted above, have one or more identical or non-identical variant ICOSL polypeptides of the invention in each polypeptide chain.

In some aspects, one or more additional IgSF domain, such as one or more additional vIgD, may be linked to a vIgD of ICOSL as provided herein (hereinafter called a "stack" or "stacked" immunomodulatory protein). In some embodiments, the modular format of the provided immunomodulatory proteins provides flexibility for engineering or generating immunomodulatory proteins for modulating activity of multiple counterstrucutres (multiple cognate binding partners). In some embodiments, such "stack" molecules can be provided in a soluble format or, in some cases, may be provided as membrane bound or secreted proteins.

In some embodiments, the immunomodulatory proteins can contain any of the variant ICOSL polypeptides provided herein linked, directly or indirectly, to one or more other immunoglobulin superfamily (IgSF) domain ("stacked" immunomodulatory protein construct and also called a "Type II" immunomodulatory protein). In some aspects, this can create unique multi-domain immunomodulatory proteins that bind two or more, such as three or more, cognate binding partners, thereby providing a multi-targeting modulation of the immune synapse.

In some embodiments, an immunomodulatory protein comprises a combination (a "non-wild-type combination") and/or arrangement (a "non-wild type arrangement" or "non-wild-type permutation") of a variant ICOSL domain with one or more other affinity modified and/or non-affinity modified IgSF domain sequences of another IgSF family member (e.g. a mammalian IgSF family member) that are not found in wild-type IgSF family members. In some embodiments, the immunomodulatory protein contains 2, 3, 4, 5 or 6 immunoglobulin superfamily (IgSF) domains, where at least one of the IgSF domain is a variant ICOSL IgSF domain (vIgD of ICOSL) according to the provided description.

In some embodiments, the sequences of the additional IgSF domains can be a modified IgSF domain that contains one or more amino acid modifications, e.g. substitutions, compared to a reference (e.g., unmodified) or wild-type IgSF domain. In some embodiments, the IgSF domain can be non-affinity modified (e.g., wild-type) or have been affinity modified. In some embodiments, the reference (e.g., unmodified) or wild-type IgSF domain can be from mouse, rat, cynomolgus monkey, or human origin, or combinations thereof. In some embodiments, the additional IgSF domains can be an IgSF domain of an IgSF family member set forth in Table 2. In some embodiments, the additional IgSF domain can be an affinity-modified IgSF domain containing one or more amino acid modifications, e.g. substitutions, compared to an IgSF domain contained in an IgSF family member set forth in Table 2.

In some embodiments, the additional IgSF domain is an affinity or non-affinity modified IgSF domain contained in an IgSF family member of a family selected from Signal-Regulatory Protein (SIRP) Family, Triggering Receptor Expressed On Myeloid Cells Like (TREML) Family, Carcinoembryonic Antigen-related Cell Adhesion Molecule (CEACAM) Family, Sialic Acid Binding Ig-Like Lectin (SIGLEC) Family, Butyrophilin Family, B7 family, CD28 family, V-set and Immunoglobulin Domain Containing (VSIG) family, V-set transmembrane Domain (VSTM) family, Major Histocompatibility Complex (MHC) family, Signaling lymphocytic activation molecule (SLAM) family, Leukocyte immunoglobulin-like receptor (LIR), Nectin (Nec) family, Nectin-like (NECL) family, Poliovirus receptor related (PVR) family, Natural cytotoxicity triggering receptor (NCR) family, T cell immunoglobulin and mucin (TIM) family or Killer-cell immunoglobulin-like receptors (KIR) family. In some embodiments, the additional IgSF domains are independently derived from an IgSF protein selected from the group consisting of CD80(B7-1), CD86 (B7-2), CD274 (PD-L1, B7-H1), PDCD1LG2(PD-L2, CD273), ICOSLG(B7RP1, CD275, ICOSL, B7-H2), CD276(B7-H3), VTCN1(B7-H4), CD28, CTLA4, PDCD1 (PD-1), ICOS, BTLA(CD272), CD4, CD8A(CD8-alpha), CD8B(CD8-beta), LAG3, HAVCR2(TIM-3), CEACAM1, TIGIT, PVR(CD155), PVRL2(CD112), CD226, CD2, CD160, CD200, CD200RT(CD200R), and NCR3 (NKp30).

The first column of Table 2 provides the name and, optionally, the name of some possible synonyms for that particular IgSF member. The second column provides the protein identifier of the UniProtKB database, a publicly available database accessible via the internet at uniprot.org or, in some cases, the GenBank Number. The Universal Protein Resource (UniProt) is a comprehensive resource for protein sequence and annotation data. The UniProt databases include the UniProt Knowledgebase (UniProtKB). UniProt is a collaboration between the European Bioinformatics Institute (EMBL-EBI), the SIB Swiss Institute of Bioinformatics and the Protein Information Resource (PIR) and supported mainly by a grant from the U.S. National Institutes of Health (NIH). GenBank is the NIH genetic sequence database, an annotated collection of all publicly available DNA sequences (Nucleic Acids Research, 2013 January; 41(DT):D36-42). The third column provides the region where the indicated IgSF domain is located. The region is specified as a range where the domain is inclusive of the residues defining the range. Column 3 also indicates the IgSF domain class for the specified IgSF region. Colum 4 provides the region where the indicated additional domains are located (signal peptide, S; extracellular domain, E; transmembrane domain, T; cytoplasmic domain, C). It is understood that description of domains can vary depending on the methods used to identify or classify the domain, and may be identified differently from different sources. The description of residues corresponding to a domain in Table 2 is for exemplification only and can be several amino acids (such as one, two, three or four) longer or shorter. Column 5 indicates for some of the listed IgSF members, some of its cognate cell surface binding partners.

TABLE 2

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| CD80 (B7-1) | NP_005182.1 P33681 | 35-135, 35-138 or 35-141, 37-138 IgV, 145-230 or 154-232 IgC | S: 1-34, E: 35-242, T: 243-263, C: 264-288 | CD28, CTLA4, PD-L1 | SEQ ID NO: 1 (35-288) | SEQ ID NO: 253 | SEQ ID NO: 28 |
| CD86 (B7-2) | P42081.2 | 33-131 IgV, 150-225 IgC2 | S: 1-23, E: 24-247, T: 248-268, C: 269-329 | CD28, CTLA4 | SEQ ID NO: 2 (24-329) | SEQ ID NO: 254 | SEQ ID NO: 29 |
| CD274 (PD-L1, B7-H1) | Q9NZQ7.1 | 24-130, 19-127, IgV, 133-225 IgC2 | S: 1-18, E: 19-238, T: 239-259, C: 260-290 | PD-1, B7-1 | SEQ ID NO: 3 (19-290) | SEQ ID NO: 255 | SEQ ID NO: 30 |
| PDCD1LG2 (PD-L2, CD273) | Q9BQ51.2 | 21-118 IgV, 122-203 IgC2 | S: 1-19, E: 20-220, T: 221-241, C: 242-273 | PD-1, RGMb | SEQ ID NO: 4 (20-273) | SEQ ID NO: 256 | SEQ ID NO: 31 |
| ICOSLG (B7RP1, CD275, ICOSL, B7-H2) | O75144.2 | 19-129 IgV, 141-227 IgC2 | S: 1-18, E: 19-256, T: 257-277, C: 278-302 | ICOS, CD28, CTLA4 | SEQ ID NO: 5 (19-302) | SEQ ID NO: 257 | SEQ ID NO: 32 |

TABLE 2-continued

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| CD276 (B7-H3) | Q5ZPR3.1 | 29-139 IgV, 145-238 IgC2, 243-357 IgV2, 367-453, 363-456 IgC2 | S: 1-28, E: 29-466, T: 467-487, C: 488-534 | | SEQ ID NO: 6 (29-534) | SEQ ID NO: 258 | SEQ ID NO: 33 |
| VTCN1 (B7-H4) | Q7Z7D3.1 | 35-146 IgV, 153-241 IgV | S: 1-24, E: 25-259, T: 260-280, C: 281-282 | | SEQ ID NO: 7 (25-282) | SEQ ID NO: 259 | SEQ ID NO: 34 |
| CD28 | P10747.1 | 28-137 IgV | S: 1-18, E: 19-152, T: 153-179, C: 180-220 | B7-1, B7-2, B7RP1 | SEQ ID NO: 8 (19-220) | SEQ ID NO: 260 | SEQ ID NO: 35 |
| CTLA4 | AAL07473.1 P16410.3 | 39-152 IgV, 39-140 IgV | S: 1-35, E: 36-161, T: 162-182, C: 183-223 | B7-1, B7-2, B7RP1 | SEQ ID NO: 9 (36-223) | SEQ ID NO: 261 | SEQ ID NO: 36 |
| PDCD1 (PD-1) | Q15116.3 | 35-145 IgV | S: 1-20, E: 21-170, T: 171-191, C: 192-288 | PD-L1, PD-L2 | SEQ ID NO: 10 (21-288) | SEQ ID NO: 262 | SEQ ID NO: 37 |
| ICOS | Q9Y6W8.1 | 30-132 IgV | S: 1-20, E: 21-140, T: 141-161, C: 162-199 | B7RP1 | SEQ ID NO: 11 (21-199) | SEQ ID NO: 263 | SEQ ID NO: 38 |
| BTLA (CD272) | Q7Z6A9.3 | 31-132 IgV | S: 1-30, E: 31-157, T: 158-178, C: 179-289 | HVEM | SEQ ID NO: 12 (31-289) | SEQ ID NO: 264 | SEQ ID NO: 39 |
| CD4 | P01730.1 | 26-125 IgV, 126-203 IgC2, 204-317 IgC2, 317-389, 318-374 IgC2 | S: 1-25, E: 26-396, T: 397-418, C: 419-458 | MHC class II | SEQ ID NO: 13 (26-458) | SEQ ID NO: 265 | SEQ ID NO: 40 |
| CD8A (CD8-alpha) | P01732.1 | 22-135 IgV | S: 1-21, E: 22-182, T: 183-203, C: 204-235 | MHC class I | SEQ ID NO: 14 (22-235) | SEQ ID NO: 266 | SEQ ID NO: 41 |
| CD8B (CD8-beta) | P10966.1 | 22-132 IgV | S: 1-21, E: 22-170, T: 171-191, C: 192-210 | MHC class I | SEQ ID NO: 15 (22-210) | SEQ ID NO: 267 | SEQ ID NO: 42 |
| LAG3 | P18627.5 | 37-167 IgV, 168-252 IgC2, 265-343 IgC2, 349-419 IgC2 | S: 1-28, E: 29-450, T: 451-471, C: 472-525 | MHC class II | SEQ ID NO: 16 (29-525) | SEQ ID NO: 268 | SEQ ID NO: 43 |
| HAVCR2 (TIM-3) | Q8TDQ0.3 | 22-124 IgV | S: 1-21, E: 22-202, T: 203-223, C: 224-301 | CEACAM-1, phosphatidylserine, Galectin-9, HMGB1 | SEQ ID NO: 17 (22-301) | SEQ ID NO: 269 | SEQ ID NO: 44 |
| CEACAM1 | P13688.2 | 35-142 IgV, 145-232 IgC2, 237-317 IgC2, 323-413 IgC2 | S: 1-34, E: 35-428, T: 429-452, C: 453-526 | TIM-3 | SEQ ID NO: 18 (35-526) | SEQ ID NO: 270 | SEQ ID NO: 45 |
| TIGIT | Q495A1.1 | 22-124 IgV | S: 1-21, E: 22-141, T: 142-162, C: 163-244 | CD155, CD112 | SEQ ID NO: 19 (22-244) | SEQ ID NO: 271 | SEQ ID NO: 46 |

TABLE 2-continued

IgSF members according to the present disclosure.

| IgSF Member (Synonyms) | NCBI Protein Accession Number/ UniProtKB Protein Identifier | IgSF Region & Domain Class | Other Domains | Cognate Cell Surface Binding Partners | IgSF Member Amino Acid Sequence (SEQ ID NO) | | |
|---|---|---|---|---|---|---|---|
| | | | | | Precursor (mature residues) | Mature | ECD |
| PVR (CD155) | P15151.2 | 24-139 IgV, 145-237 IgC2, 244-328 IgC2 | S: 1-20, E: 21-343, T: 344-367, C: 368-417 | TIGIT, CD226, CD96, poliovirus | SEQ ID NO: 20 (21-417) | SEQ ID NO: 272 | SEQ ID NO: 47 |
| PVRL2 (CD112) | Q92692.1 | 32-156 IgV, 162-256 IgC2, 261-345 IgC2 | S: 1-31, E:32-360, T: 361-381, C: 382-538 | TIGIT, CD226, CD112R | SEQ ID NO: 21 (32-538) | SEQ ID NO: 273 | SEQ ID NO: 48 |
| CD226 | Q15762.2 | 19-126 IgC2, 135-239 IgC2 | S:1-18, E: 19-254, T: 255-275, C: 276-336 | CD155, CD112 | SEQ ID NO: 22 (19-336) | SEQ ID NO: 274 | SEQ ID NO: 49 |
| CD2 | P06729.2 | 25-128 IgV, 129-209 IgC2 | S: 1-24, E: 25-209, T: 210-235, C: 236-351 | CD58 | SEQ ID NO: 23 (25-351) | SEQ ID NO: 275 | SEQ ID NO: 50 |
| CD160 | O95971.1 | 27-122 IgV | S: 1-26 E: 27-122 | HVEM, MHC family of proteins | SEQ ID NO: 24 (27-159) | SEQ ID NO: 276 | SEQ ID NO: 51 |
| CD200 | P41217.4 | 31-141 IgV, 142-232 IgC2 | S: 1-30, E:31-232, T: 233-259, C: 260-278 | CD200R | SEQ ID NO: 25 (31-278) | SEQ ID NO: 277 | SEQ ID NO: 52 |
| CD200R1 (CD200R) | Q8TD46.2 | 53-139 IgV, 140-228 IgC2 | S: 1-28, E: 29-243, T: 244-264, C: 265-325 | CD200 | SEQ ID NO: 26 (29-325) | SEQ ID NO: 278 | SEQ ID NO: 53 |
| NCR3 (NKp30) | O14931.1 | 19-126 IgC-like | S: 1-18, E: 19-135, T: 136-156, C: 157-201 | B7-H6 | SEQ ID NO: 27 (19-201) | SEQ ID NO: 279 | SEQ ID NO: 54 |
| VSIG8 | Q5VU13 | 22-141 IgV1 146-257 IgV2 | S: 1-21 E: 22-263 T: 264-284 C: 285-414 | VISTA | SEQ ID NO: 341 (22-414) | SEQ ID NO: 342 | SEQ ID NO: 343 |

In some embodiments, the provided immunomodulatory proteins, in addition to containing a variant ICOSL polypeptide, also contains at least 1, 2, 3, 4, 5 or 6 additional immunoglobulin superfamily (IgSF) domains, such as an IgD domain of an IgSF family member set forth in Table 2.

In some embodiments, the provided immunomodulatory protein contains at least one additional IgSF domain (e.g. second IgSF domain). In some embodiments, the provided immunomodulatory protein contains at least two additional IgSF domains (e.g. second and third IgSF domain). In some embodiments, the provided immunomodulatory protein contains at least three additional IgSF domains (e.g. second, third and fourth). In some embodiments, the provided immunomodulatory protein contains at least four additional IgSF domains (e.g. second, third, fourth and fifth). In some embodiments, the provided immunomodulatory protein contains at least five additional IgSF domains (e.g. second, third, fourth, fifth and sixth). In some embodiments, the provided immunomodulatory protein contains at least six additional IgSF domains (e.g. second, third, fourth, fifth, sixth and seventh). In some embodiments, each of the IgSF domains in the immunomodulatory protein are different. In some embodiments, at least one of the additional IgSF domain is the same as at least one other IgSF domain in the immunomodulatory protein. In some embodiments, each of the IgSF domains is from or derived from a different IgSF family member. In some embodiments, at least two of the IgSF domains is from or derived from the same IgSF family member.

In some embodiments, the additional IgSF domain comprises an IgV domain or an IgC (e.g., IgC2) domain or domains, or a specific binding fragment of the IgV domain or a specific binding fragment of the IgC (e.g., IgC2) domain or domains. In some embodiments, the additional IgSF domain is or comprises a full-length IgV domain. In some embodiments, the additional IgSF domain is or comprises a full-length IgC (e.g., IgC2) domain or domains. In some embodiments, the additional IgSF domain is or comprises a specific binding fragment of the IgV domain. In some embodiments, the additional IgSF domain is or comprises a specific binding fragment of the IgC (e.g., IgC2) domain or domains. In some embodiments, the immunomodulatory protein contains at least two additional IgSF domains from a single (same) IgSF member. For example, in some aspects, the immunomodulatory protein contains an ECD or portion thereof of an IgSF member containing a full-length IgV domain and a full-length IgC (e.g., IgC2) domain or domains or specific binding fragments thereof.

In some embodiments, the provided immunomodulatory proteins contain at least one additional IgSF domain (e.g. a second or, in some cases, also a third IgSF domain) in which at least one additional, e.g., second or third IgSF domain, is an IgSF domain set forth in a reference (e.g., unmodified) or wild-type IgSF domain or a specific binding fragment thereof contained in the sequence of amino acids set forth in any of SEQ ID NOS: 1-27 and 341. In some embodiments, the reference (e.g., unmodified) or wild-type IgSF domain is an IgV domain or an IgC domain, such as an IgC1 or IgC2 domain.

In some embodiments, the provided immunomodulatory proteins, in addition to containing a variant ICOSL polypeptide, also contains at least one additional IgSF domain (e.g. a or, in some cases, also a third affinity-modified IgSF domain and so on) in which at least one additional IgSF domain is a vIgD that contains one or more amino acid modifications (e.g. substitution, deletion or mutation) compared to an IgSF domain in a reference (e.g., unmodified) or wild-type IgSF domain, such as an IgSF domain in an IgSF family member set forth in Table 2. In some embodiments, the additional, e.g., second or third affinity-modified IgSF domain comprises at least 85%, 86%, 87%, 88%, 89%, 90%, 91%, 92%, 93%, 94%, 95%, 96%, 97%, 98%, 99% or more sequence identity to a reference (e.g., unmodified) or wild-type IgSF domain or a specific binding fragment thereof contained in the sequence of amino acids set forth in any of SEQ ID NOS: 1-27 and 341. In some embodiments, the reference (e.g., unmodified) or wild-type IgSF domain is an IgV domain or an IgC domain, such as an IgC1 or IgC2 domain. In some embodiments, the additional, e.g., second or third IgSF domain is an affinity-modified IgV domain and/or IgC domain. In some embodiments, the one or more additional IgSF domain is an affinity-modified IgSF domain that contains an IgV domain and/or an IgC (e.g., IgC2) domain or domains, or a specific binding fragment of the IgV domain and/or a specific binding fragment of the IgC (e.g., IgC2) domain or domains, in which the IgV and/or IgC domain contains the amino acid modification(s) (e.g., substitution(s)). In some embodiments, the one or more additional affinity-modified IgSF domain contains an IgV domain containing the amino acid modification(s) (e.g. substitution(s)). In some embodiments, the one or more additional affinity-modified IgSF domain include IgSF domains present in the ECD or a portion of the ECD of the corresponding reference IgSF family member, such as a full-length IgV domain and a full-length IgC (e.g., IgC2) domain or domains, or specific binding fragments thereof, in which one or both of the IgV and IgC contain the amino acid modification(s) (e.g. substitution(s)). In some embodiments, the particular domain or each of the particular domains (e.g. additional, e.g., second or third IgSF domain) of a variant IgSF domain polypeptide can be several amino acids longer or shorter, such as 1-10, e.g., 1, 2, 3, 4, 5, 6 or 7 amino acids longer or shorter, than the sequence of amino acids set forth in the respective SEQ ID NO.

In some embodiments, the provided immunomodulatory protein contains at least one additional, (e.g., second or, in some cases, also a third IgSF domain and so on) or second IgSF domain that is a vIgD that contains one or more amino acid substitutions compared to an IgSF domain (e.g., IgV) of a reference (e.g., unmodified) or wild-type IgSF domain other than ICOSL.

In some embodiments, the additional or second IgSF domain contains one or more amino acid substitutions compared to an IgSF domain in a reference (e.g., unmodified) or wild-type IgSF domain, such as an IgSF domain in an IgSF family member set forth in Table 2. In some embodiments, the additional or second affinity-modified IgSF domain comprises at least 85%, 86%, 87%, 88%, 89%, 90%, 91%, 92%, 93%, 94%, 95%, 96%, 97%, 98%, 99% or more sequence identity to a reference (e.g., unmodified) or wild-type IgSF domain or a specific binding fragment thereof contained in the sequence of amino acids set forth in any of SEQ ID NOS: 1-27. In some embodiments, the reference (e.g., unmodified) or wild-type IgSF domain is an IgV domain or an IgC domain, such as an IgC1 or IgC2 domain. In some embodiments, the additional or second IgSF domain is an affinity-modified IgV domain or IgC domain. Tables 3-5 provide exemplary polypeptides containing one or more affinity-modified IgSF domains that can be used in stack constructs provided herein.

In some embodiments, the one or more additional IgSF domain (e.g. second IgSF) domain is an IgSF domain (e.g. IgV) of another IgSF family member that binds or recognizes a tumor antigen. In such embodiments, the IgSF family member serves as a tumor-localizing moiety, thereby bringing the vIgD of ICOSL in close proximity to immune cells in the tumor microenvironment. In some embodiments, the additional IgSF domain (e.g. second IgSF) domain is an IgSF domain of NKp30, which binds or recognizes B7-H6 expressed on a tumor cell. In some embodiments, the at least one additional (e.g. second) IgSF domain, e.g. NKp30, is a vIgD that contains one or more amino acid modifications (e.g. substitutions, deletions or additions). In some embodiments, the one or more amino acid modifications increase binding affinity and/or selectivity to B7-H6 compared to reference IgSF domain, e.g. NKp30, such as by at least or at least about 1.2-fold, 1.5-fold, 2-fold, 3-fold, 4-fold, 5-fold, 6-fold, 7-fold, 8-fold, 9-fold 10-fold 20-fold 30-fold 40-fold or 50-fold.

TABLE 3

Exemplary variant CD80 polypeptides

| Mutation(s) | ECD SEQ ID NO | IgV SEQ ID NO |
|---|---|---|
| Wild-type | 28 | 152 |
| L70Q/A91G | 55 | 153 |
| L70Q/A91G/T130A | 56 | |
| L70Q/A91G/I118A/T120S/T130A | 57 | |
| V4M/L70Q/A91G/T120S/T130A | 58 | 154 |
| L70Q/A91G/T120S/T130A | 59 | |
| V20L/L70Q/A91S/T120S/T130A | 60 | 155 |
| S44P/L70Q/A91G/T130A | 61 | 156 |
| L70Q/A91G/E117G/T120S/T130A | 62 | |
| A91G/T120S/T130A | 63 | 157 |
| L70R/A91G/T120S/T130A | 64 | 158 |
| L70Q/E81A/A91G/T120S/I127T/T130A | 65 | 159 |
| L70Q/Y87N/A91G/T130A | 66 | 160 |
| T28S/L70Q/A91G/E95K/T120S/T130A | 67 | 161 |
| N63S/L70Q/A91G/T120S/T130A | 68 | 162 |
| K36E/I67T/L70Q/A91G/T120S/T130A/N152T | 69 | 163 |
| E52G/L70Q/A91G/T120S/T130A | 70 | 164 |
| K37E/F59S/L70Q/A91G/T120S/T130A | 71 | 165 |
| A91G/S103P | 72 | |

TABLE 3-continued

Exemplary variant CD80 polypeptides

| Mutation(s) | ECD SEQ ID NO | IgV SEQ ID NO |
|---|---|---|
| K89E/T130A | 73 | 166 |
| A91G | 74 | |
| D60V/A91G/T120S/T130A | 75 | 167 |
| K54M/A91G/T120S | 76 | 168 |
| M38T/L70Q/E77G/A91G/T120S/T130A/N152T | 77 | 169 |
| R29H/E52G/L70R/E88G/A91G/T130A | 78 | 170 |
| Y31H/T41G/L70Q/A91G/T120S/T130A | 79 | 171 |
| V68A/T110A | 80 | 172 |
| S66H/D90G/T110A/F116L | 81 | 173 |
| R29H/E52G/T120S/T130A | 82 | 174 |
| A91G/L102S | 83 | |
| I67T/L70Q/A91G/T120S | 84 | 175 |
| L70Q/A91G/T110A/T120S/T130A | 85 | |
| M38V/T41D/M43I/W50G/D76G/V83A/K89E/T120S/T130A | 86 | 176 |
| V22A/L70Q/S121P | 87 | 177 |
| A12V/S15F/Y31H/T41G/T130A/P137L/152T | 88 | 178 |
| I67F/L70R/E88G/A91G/T120S/T130A | 89 | 179 |
| E24G/L25P/L70Q/T120S | 90 | 180 |
| A91G/F92L/F108L/T120S | 91 | 181 |
| R29D/Y31L/Q33H/K36G/M38I/T41A/M43R/M47T/E81V/L85R/K89N/A91T/F92P/K93V/R94L/I118T/N149S | 92 | 182 |
| R29D/Y31L/Q33H/K36G/M38I/T41A/M43R/M47T/E81V/L85R/K89N/A91T/F92P/K93V/R94L/N144S/N149S | 93 | |
| R29D/Y31L/Q33H/K36G/M38I/T41A/M42T/M43R/M47T/E81V/L85R/K89N/A91T/F92P/K93V/R94L/L148S/N149S | 94 | 183 |
| E24G/R29D/Y31L/Q33H/K36G/M38I/T41A/M43R/M47T/F59L/E81V/L85R/K89N/A91T/F92P/K93V/R94L/H96R/N149S/C182S | 95 | 184 |
| R29D/Y31L/Q33H/K36G/M38I/T41A/M43R/M47T/E81V/L85R/K89N/A91T/F92P/K93V/R94L/N149S | 96 | |
| R29V/M43Q/E81R/L85I/K89R/D90L/A91E/F92N/K93Q/R94G | 97 | 185 |
| T41I/A91G | 98 | 186 |
| K89R/D90K/A91G/F92Y/K93R/N122S/N177S | 99 | 187 |
| K89R/D90K/A91G/F92Y/K93R | 100 | |
| K36G/K37Q/M38I/F59L/E81V/L85R/K89N/A91T/F92P/K93V/R94L/E99G/T130A/N149S | 101 | 188 |
| E88D/K89R/D90K/A91G/F92Y/K93R | 102 | 189, 543 |
| K36G/K37Q/M38I/L40M | 103 | 190 |
| K36G | 104 | 191 |
| R29H/Y31H/T41G/Y87N/E88G/K89E/D90N/A91G/P109S | 105 | 192 |
| A12T/H18L/M43V/F59L/E77K/P109S/I118T | 106 | 193 |
| R29V/Y31F/K36G/M38L/M43Q/E81R/V83I/L85I/K89R/D90L/A91E/F92N/K93Q/R94G | 107 | 194 |
| V68M/L70P/L72P/K86E | 108 | 195 |
| L70Q/A91G/N144D | 508 | |
| L70Q/A91G/I118A/T120S/T130A/K169E | 509 | |
| V4M/L70Q/A91G/I118V/T120S/T130A/K169E | 510 | |
| L70Q/A91G/I118V/T120S/T130A/K169E | 511 | |
| L70Q/A91G/I118V/T120S/T130A | 512 | |
| V20L/L70Q/A91S/I118V/T120S/T130A | 513 | |
| L70Q/A91G/E117G/I118V/T120S/T130A | 514 | |
| A91G/I118V/T120S/T130A | 515 | |
| L70R/A91G/I118V/T120S/T130A/T199S | 516 | |
| L70Q/E81A/A91G/I118V/T120S/I127T/T130A | 517 | |
| T28S/L70Q/A91G/E95K/I118V/T120S/I126V/T130A/K169E | 518 | |
| N63S/L70Q/A91G/S114T/I118V/T120S/T130A | 519 | |
| K36E/I67T/L70Q/A91G/I118V/T120S/T130A/N152T | 520 | |
| E52G/L70Q/A91G/D107N/I118V/T120S/T130A/K169E | 521 | |
| K37E/F59S/L70Q/A91G/I118V/T120S/T130A/K185E | 522 | |
| D60V/A91G/I118V/T120S/T130AK169E | 523 | |
| K54M/L70Q/A91G/Y164H/T120S | 524 | |
| M38T/L70Q/E77G/A91G/I118V/T120S/T130A/N152T | 525 | |
| Y31H/T41G/M43L/L70Q/A91G/I118V/T120S/I126V/T130A | 526 | |
| LS656H/D90G/T110A/F116L | 527 | |
| R29H/E52G/D90N/I118V/T120S/T130A | 528 | |
| R29H/E52G/D90N/I118V/T120S/T130A | 529 | |
| I67T/L70Q/A91G/I118V/T120S | 530 | |
| L70Q/A91G/T110A/I118V/T120S/T130A | 531 | |
| M38V/T41D/M43I/W50G/D76G/V83/K89E/I118V/T120S/I126V/T130A | 532 | |
| A12V/S15F/Y31H/M38L/T41G/M43L/D90N/T130A/P137L/N149D/N152T | 533 | |
| I67F/L70R/E88G/A91G/I118V/T120S/T130A | 534 | |
| E24G/L25P/L70Q/A91G/I118V/T120S/N152T | 535 | |
| A91G/F92L/F108L/I118V/T120S | 536 | |
| E88D/K89R/D90K/A91G/F92Y/K93R/N122S/N177S | 537 | |
| K36G/K37Q/M38I/L40M/F59L/E81V/L85R/K89N/A91T/F92P/K93V/R94L/E99G/T130A/N149S | 539 | |
| K36G/L40M | 540 | 542, 544 |

TABLE 4

Exemplary variant NKp30 polypeptides

| Mutation(s) | ECD SEQ ID NO | IgC-like domain SEQ ID NO | IgV-like domain SEQ ID NO |
|---|---|---|---|
| Wild-type | 54 | 214 | 929 |
| L30V/A60V/S64P/S86G | 143 | 215 | 504 |
| L30V | 144 | 216 | 930 |
| A60V | 145 | 217 | 931 |
| S64P | 146 | 218 | 932 |
| S86G | 147 | 219 | 933 |

TABLE 5

Exemplary variant CD86 polypeptides

| Mutation(s) | ECD SEQ ID NO | IgV SEQ ID NO |
|---|---|---|
| Wild-type | 29 | 220 |
| Q35H/H90L/Q102H | 148 | 221 |
| Q35H | 149 | 222 |
| H90L | 150 | 223 |
| Q102H | 151 | 224 |

The number of such non-affinity modified or affinity modified IgSF domains present in a "stacked" immunomodulatory protein construct (whether non-wild type combinations or non-wild type arrangements) is at least 2, 3, 4, or 5 and in some embodiments exactly 2, 3, 4, or 5 IgSF domains (whereby determination of the number of affinity modified IgSF domains disregards any non-specific binding fractional sequences thereof and/or substantially immunologically inactive fractional sequences thereof).

In some embodiments of a stacked immunomodulatory protein provided herein, the number of IgSF domains is at least 2 wherein the number of affinity modified and the number of non-affinity modified IgSF domains is each independently at least: 0, 1, 2, 3, 4, 5, or 6. Thus, the number of affinity modified IgSF domains and the number of non-affinity modified IgSF domains, respectively, (affinity modified IgSF domain: non-affinity modified IgSF domain), can be exactly or at least: 2:0 (affinity modified: wild-type), 0:2, 2:1, 1:2, 2:2, 2:3, 3:2, 2:4, 4:2, 1:1, 1:3, 3:1, 1:4, 4:1, 1:5, or 5:1.

In some embodiments of a stacked immunomodulatory protein, at least two of the non-affinity modified and/or affinity modified IgSF domains are identical IgSF domains.

In some embodiments, a stacked immunomodulatory protein provided herein comprises at least two affinity modified and/or non-affinity modified IgSF domains from a single IgSF member but in a non-wild-type arrangement (alternatively, "permutation"). One illustrative example of a non-wild type arrangement or permutation is an immunomodulatory protein comprising a non-wild-type order of affinity modified and/or non-affinity modified IgSF domain sequences relative to those found in the wild-type ICOSL whose IgSF domain sequences served as the source of the variant IgSF domains as provided herein. Thus, in one example, the immunomodulatory protein can comprise an IgV proximal and an IgC distal to the transmembrane domain albeit in a non-affinity modified and/or affinity modified form. The presence, in an immunomodulatory protein provided herein, of both non-wild-type combinations and non-wild-type arrangements of non-affinity modified and/or affinity modified IgSF domains is also within the scope of the provided subject matter.

In some embodiments of a stacked immunomodulatory protein, the non-affinity modified and/or affinity modified IgSF domains are non-identical (i.e., different) IgSF domains. Non-identical affinity modified IgSF domains specifically bind, under specific binding conditions, different cognate binding partners and are "non-identical" irrespective of whether or not the reference (e.g., unmodified) or wild-type IgSF domains from which they are engineered was the same. Thus, for example, a non-wild-type combination of at least two non-identical IgSF domains in an immunomodulatory protein can comprise at least one IgSF domain sequence whose origin is from and unique to one ICOSL, and at least one of a second IgSF domain sequence whose origin is from and unique to another IgSF family member that is not ICOSL, wherein the IgSF domains of the immunomodulatory protein are in non-affinity modified and/or affinity modified form. However, in alternative embodiments, the two non-identical IgSF domains originate from the same IgSF domain sequence but at least one is affinity modified such that they specifically bind to different cognate binding partners.

A plurality of non-affinity modified and/or affinity modified IgSF domains in a stacked immunomodulatory protein polypeptide chain need not be covalently linked directly to one another. In some embodiments, an intervening span of one or more amino acid residues indirectly covalently bonds the non-affinity modified and/or affinity modified IgSF domains to each other. The linkage can be via the N-terminal to C-terminal residues.

In some embodiments, the linkage can be made via side chains of amino acid residues that are not located at the N-terminus or C-terminus of the non-affinity modified and/or affinity modified IgSF domain. Thus, linkages can be made via terminal or internal amino acid residues or combinations thereof.

In some embodiments, the two or more IgSF domain, including a vIgD of ICOSL and one or more additional IgSF domain (e.g. second or third variant IgSF domain) from another IgSF family member, are covalently or non-covalently linked. In some embodiments, the two or more IgSF domains are linked directly or indirectly, such as via a linker. In some embodiments, an intervening span of one or more amino acid residues indirectly covalently bonds IgSF domains to each other. The linkage can be via the N-terminal to C-terminal residues. In some embodiments, the linkage can be made via side chains of amino acid residues that are not located at the N-terminus or C-terminus of the IgSF domain(s). Thus, linkages can be made via terminal or internal amino acid residues or combinations thereof.

Figure 16A:
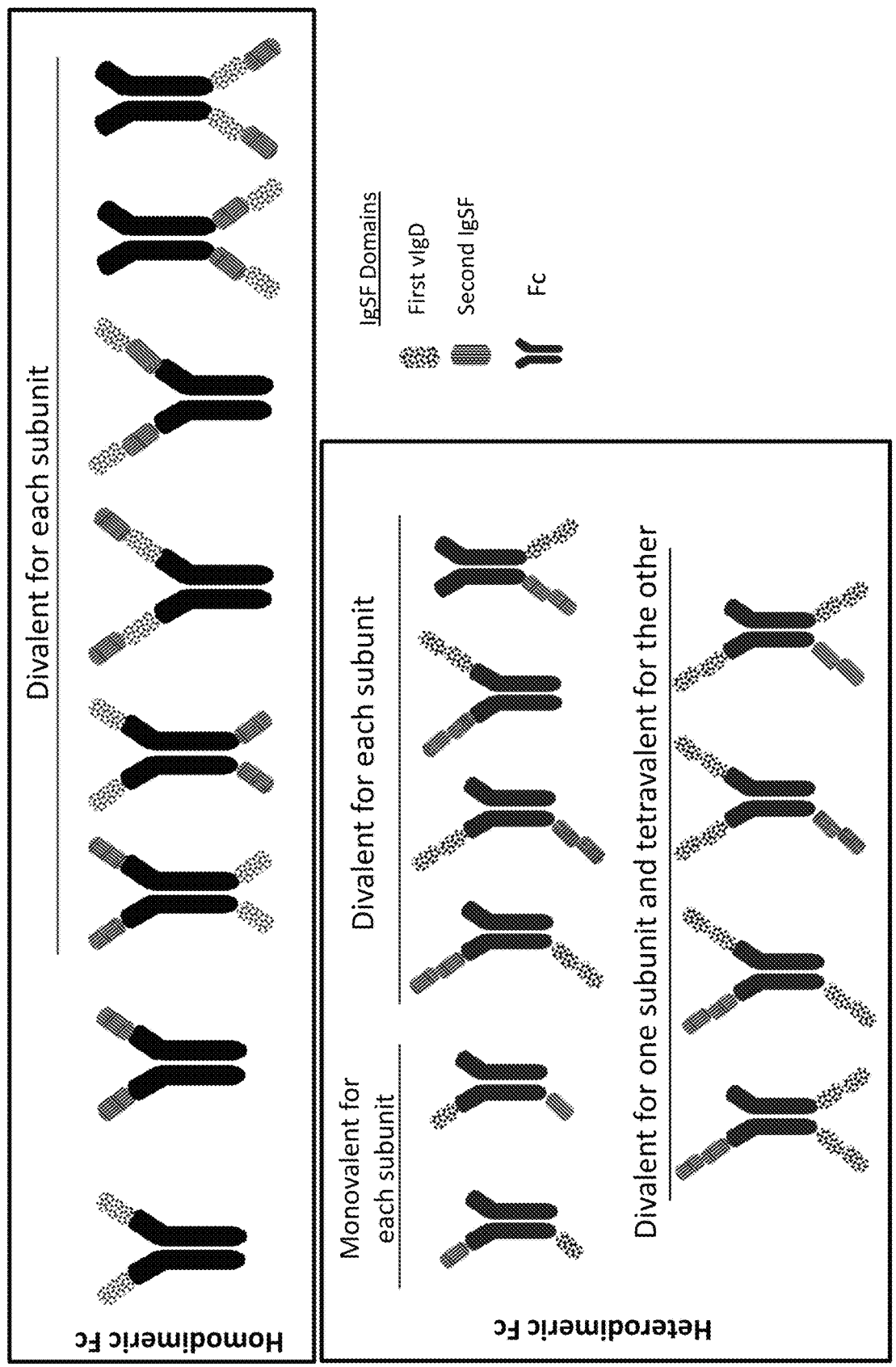
FIG. 16A depicts various exemplary configurations of a stack molecule containing a first variant IgSF domain (first vIgD), e.g. variant ICOSL, and a second IgSF domain, such as a second variant IgSF domain (second vIgD). As shown, the first vIgD and second IgSF domain are independently linked, directly or indirectly, to the N- or C-terminus of an Fc region. For generating a homodimeric Fc molecule, the Fc region is one that is capable of forming a homodimer with a matched Fc subunit by co-expression of the individual Fc regions in a cell. For generating a heterodimeric Fc molecule, the individual Fc regions contain mutations (e.g. "knob-into-hole" mutations in the CH3 domain), such that formation of the heterodimer is favored compared to homodimers when the individual Fc regions are co-expressed in a cell.
Figure 16B:
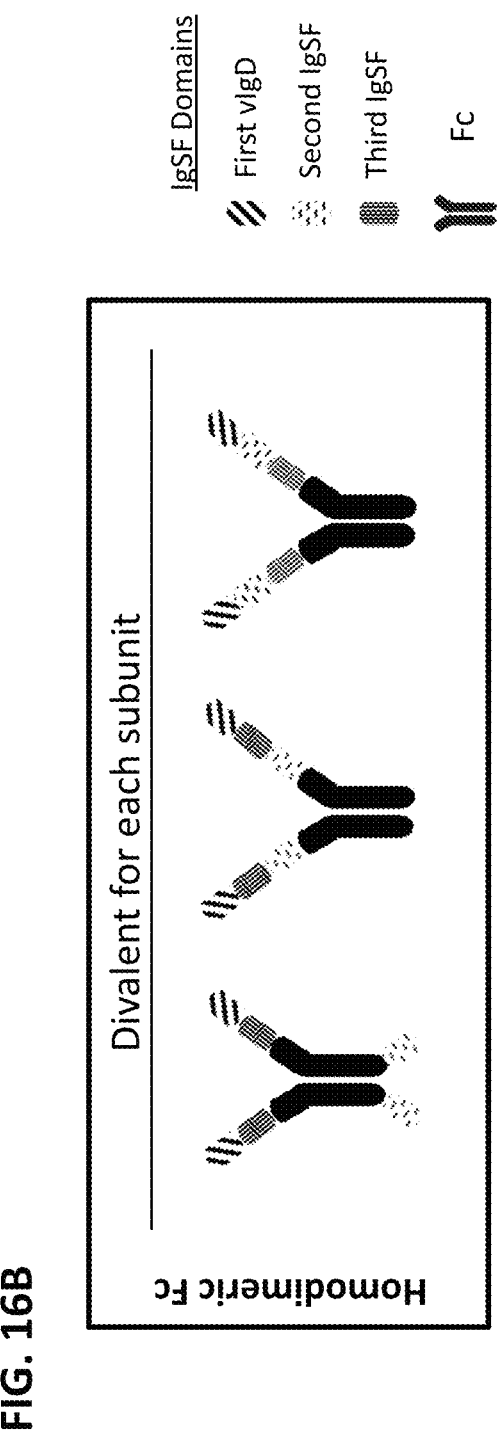
FIG. 16B depicts various exemplary configurations of a stack molecule containing a first variant IgSF domain (first vIgD), a second IgSF domain, such as a second variant IgSF domain (second vIgD), and a third IgSF domain, such as a third variant IgSF domain (third vIgD). As shown, the first vIgD, second IgSF, and third IgSF domains are independently linked, directly or indirectly, to the N- or C-terminus of an Fc region. For generating a homodimeric Fc molecule, the Fc region is one that is capable of forming a homodimer with a matched Fc region by co-expression of the individual Fc regions in a cell.
Figure 17:
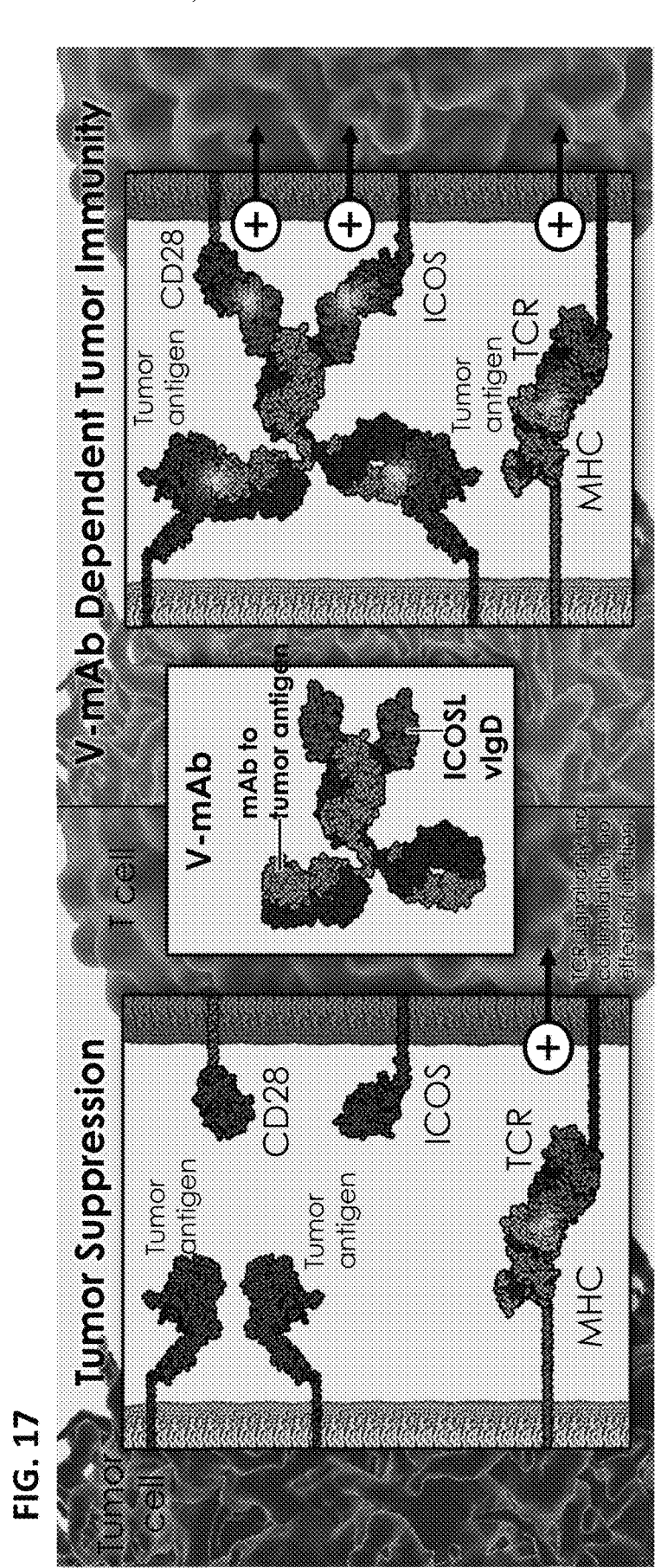
FIG. 17 depicts an exemplary schematic of the activity of a variant IgSF domain (vIgD) conjugated to an antibody (V-Mab) in which the antibody (e.g. anti-HER2 antibody) binds to an antigen on the surface of the tumor cell. In this depiction, the vIgD is a variant of an IgSF domain of ICOSL. As shown, binding of the antibody to the surface of the tumor cell localizes the vIgD on the tumor cell surface where it can interact with one or more of its cognate binding partners expressed on the surface of an adjacent immune cell (e.g. T cell) to agonize receptor signaling. In an exemplary embodiment as shown, the variant IgSF domain (vIgD) is a variant of an IgSF domain of ICOSL. Binding of the ICOSL vIgD to CD28 or ICOS costimulatory receptors provides an agonist or costimulatory signal.

In some embodiments, the immunomodulatory protein contains at least two IgSF domains, each linked directly or indirectly via a linker. In some embodiments, the immunomodulatory protein contains at least three immunomodulatory proteins, each linked directly or indirectly via a linker. Various configurations are shown in FIGS. 16A and 16B.

In some embodiments, one or more "peptide linkers" link the vIgD of ICOSL and one or more additional IgSF domain (e.g. second or third variant IgSF domain). In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is a flexible linker. In some embodiments, the linker is (in one-letter amino acid code): GGGGS ("4GS"; SEQ ID NO: 636) or multimers of the 4GS linker, such as repeats of 2, 3, 4, or 5 4GS linkers. In some embodiments, the peptide linker is (GGGGS)$_2$ or (GGGGS)$_3$ as set forth in SEQ ID NOs: 229 and 228, respectively. In some embodiments, the linker also can include a series of alanine residues alone or in addition to another peptide linker (such as a 4GS linker or multimer thereof). In some embodiments, the number of alanine residues in each series is: 2, 3, 4, 5, or 6 alanines. In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 EAAAK linkers, such as set forth in SEQ ID NO: 629 (1×EAAAK), SEQ ID NO: 630 (3×EAAAK) or SEQ ID NO: 631 (5×EAAAK). In some embodiments, the linker can further include amino acids introduced by cloning and/or from a restriction site, for example the linker can include the amino acids GS (in one-letter amino acid code) as introduced by use of the restriction site BAMHI. In some embodiments, the linker (in one-letter amino acid code) is GSGGGGS (SEQ ID NO: 635). In some examples, the linker is a 2×GGGGS followed by three alanines (GGGGSGGGGSAAA; SEQ ID NO: 230).

In some embodiments, the non-affinity modified and/or affinity modified IgSF domains are linked by "wild-type peptide linkers" inserted at the N-terminus and/or C-terminus of a second non-affinity modified and/or affinity modified IgSF domains. In some embodiments, there is present a leading peptide linker inserted at the N-terminus of the first IgSF domain and/or a first trailing sequence inserted at the C-terminus of the first non-affinity modified and/or affinity modified IgSF domain. In some embodiments, there is present a second leading peptide linker inserted at the N-terminus of the second IgSF domain and/or a second trailing sequence inserted at the C-terminus of the second non-affinity modified and/or affinity modified IgSF domain. When the first and second non-affinity modified and/or affinity modified IgSF domains are derived from the same parental protein and are connected in the same orientation, wild-type peptide linkers between the first and second non-affinity modified and/or affinity modified IgSF domains are not duplicated. For example, when the first trailing wild-type peptide linker and the second leading wild-type peptide linker are the same, the Type II immunomodulatory protein does not comprise either the first trailing wild-type peptide linker or the second leading wild-type peptide linker.

In some embodiments, the Type II immunomodulatory protein comprises a first leading wild-type peptide linker inserted at the N-terminus of the first non-affinity modified and/or affinity modified IgSF domain, wherein the first leading wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately preceding domain (such as a signal peptide or an IgSF domain). In some embodiments, the first leading wild-type peptide linker comprises the entire intervening sequence in the wild-type protein from which the first non-affinity modified and/or affinity modified IgSF domain is derived between the parental IgSF domain and the immediately preceding domain (such as a signal peptide or an IgSF domain).

In some embodiments, the Type II immunomodulatory protein further comprises a first trailing wild-type peptide linker inserted at the C-terminus of the first non-affinity modified and/or affinity modified IgSF domain, wherein the first trailing wild-type peptide linker comprises at least 5 (such as at least about any of 6, 7, 8, 9, 10, 11, 12, 13, 14, 15, or more) consecutive amino acids from the intervening sequence in the wild-type protein from which the first non-affinity modified and/or affinity modified IgSF domain is derived between the parental IgSF domain and the immediately following domain (such as an IgSF domain or a transmembrane domain). In some embodiments, the first trailing wild-type peptide linker comprises the entire intervening sequence in the wild-type protein from which the first non-affinity modified and/or affinity modified IgSF domain is derived between the parental IgSF domain and the immediately following domain (such as an IgSF domain or a transmembrane domain).

In some embodiments, the Type II immunomodulatory protein further comprises a second leading wild-type peptide linker inserted at the N-terminus of the second non-affinity modified and/or affinity modified IgSF domain, wherein the second leading wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately preceding domain (such as a signal peptide or an IgSF domain). In some embodiments, the second leading wild-type peptide linker comprises the entire intervening sequence in the wild-type protein from which the second non-affinity modified and/or affinity modified IgSF domain is derived between the parental IgSF domain and the immediately preceding domain (such as a signal peptide or an IgSF domain).

In some embodiments, the Type II immunomodulatory protein further comprises a second trailing wild-type peptide linker inserted at the C-terminus of the second non-affinity modified and/or affinity modified IgSF domain, wherein the second trailing wild-type peptide linker comprises at least 5 (such as at least about any of 6, 7, 8, 9, 10, 11, 12, 13, 14, 15, or more) consecutive amino acids from the intervening sequence in the wild-type protein from which the second non-affinity modified and/or affinity modified IgSF domain is derived between the parental IgSF domain and the immediately following domain (such as an IgSF domain or a transmembrane domain). In some embodiments, the second trailing wild-type peptide linker comprises the entire intervening sequence in the wild-type protein from which the second non-affinity modified and/or affinity modified IgSF domain is derived between the parental IgSF domain and the immediately following domain (such as an IgSF domain or a transmembrane domain).

Exemplary of a leading sequence and trailing sequence for a Type II protein containing a CD80 IgSF domain is set forth in SEQ ID NO:231 and SEQ ID NO:232. Exemplary of a leading sequence and trailing sequence for a Type II protein containing an ICOSL IgSF domain is set forth in SEQ ID NO: 233 and 234. Exemplary of a leading sequence and a trailing sequence for a Type II protein containing a CD86 IgSF domain is set forth in any of SEQ ID NOS: 236-238. Exemplary of a wild-type linker sequence for a Type II protein containing an NKp30 IgSF domain is set forth in SEQ ID NO: 235.

1. Monovalent

Provided herein are immunomodulatory proteins containing a variant ICOSL polypeptide that is monovalent. In some embodiments, the variant ICOSL polypeptide of the monovalent immunomodulatory protein is linked, directly or indirectly, to a further moiety. In some embodiments, the further moiety is a protein, peptide, small molecule or nucleic acid. In some embodiments, the monovalent immunomodulatory protein is a fusion protein.

In some embodiments, the moiety is a half-life extending molecule. Exemplary of such half-life extending molecules include, but are not limited to, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

In some embodiments, the immunomodulatory polypeptide comprising a variant ICOSL can include conformationally disordered polypeptide sequences composed of the amino acids Pro, Ala, and Ser (See e.g., WO2008/155134; SEQ ID NO: 904). In some cases, the amino acid repeat is at least 3, 4, 5, 6, 7, 8, 9, 10, 11, 12, 13, 14, 15, 16, 17, 18, 19, 20, 21, 22, 23, 24, 25, 26, 27, 28, 29, 30 or more amino acid residues, wherein each repeat comprises (an) Ala, Ser, and Pro residue(s). Thus, provided herein is an immunomodulatory protein is a PASylated protein wherein the variant ICOSL polypeptide is linked, directly or indirectly via a linker, to Pro/Ala/Ser (PAS). In some embodiments, one or more additional linker structures may be used.

In some embodiments, the moiety facilitates detection or purification of the variant ICOSL polypeptide. In some cases, the immunomodulatory polypeptide comprises a tag or fusion domain, e.g. affinity or purification tag, linked, directly or indirectly, to the N- and/or c-terminus of the ICOSL polypeptide. Various suitable polypeptide tags and/or fusion domains are known, and include but are not limited to, a poly-histidine (His) tag, a FLAG-tag (SEQ ID NO: 865), a Myc-tag, and fluorescent protein-tags (e.g., EGFP, set forth in SEQ ID NOs: 858, 859, or 896). In some cases, the immunomodulatory polypeptide comprising a variant ICOSL comprises at least six histidine residues (set forth in SEQ ID NO: 864). In some cases, the immunomodulatory polypeptide comprising a variant ICOSL further comprises various combinations of moieties. For example, the immunomodulatory polypeptide comprising a variant ICOSL further comprises one or more polyhistidine-tag and FLAG tag.

In some embodiments, the ICOSL polypeptide is linked to a modified immunoglobulin heavy chain constant region (Fc) that remains in monovalent form such as set forth in SEQ ID NO: 472.

2. Bivalent

In some embodiments, the immunomodulatory protein containing a variant ICOSL is multivalent, such as bivalent. In aspects, the immunomodulatory protein is linked, directly or indirectly via a linker, to a multimerization domain. In some aspects, the multimerization domain increase half-life of the molecule.

Interaction of two or more variant ICOSL polypeptides can be facilitated by their linkage, either directly or indirectly, to any moiety or other polypeptide that are themselves able to interact to form a stable structure. For example, separate encoded variant ICOSL polypeptide chains can be joined by multimerization, whereby multimerization of the polypeptides is mediated by a multimerization domain. Typically, the multimerization domain provides for the formation of a stable protein-protein interaction between a first variant ICOSL polypeptide and a second variant ICOSL polypeptide. Homo- or heteromultimeric polypeptides can be generated from co-expression of separate variant ICOSL polypeptides. The first and second variant ICOSL polypeptides can be the same or different.

In some embodiments, a multimerization domain includes any capable of forming a stable protein-protein interaction. The multimerization domains can interact via an immunoglobulin sequence (e.g. Fc domain; see e.g., International Patent Pub. Nos. WO 93/10151 and WO 2005/063816 US; U.S. Pub. No. 2006/0024298; U.S. Pat. No. 5,457,035); leucine zipper (e.g. from nuclear transforming proteins fos and jun or the proto-oncogene c-myc or from General Control of Nitrogen (GCN4)) (ee e.g., Busch and Sassone-Corsi (1990) Trends Genetics, 6:36-40; Gentz et al., (1989) Science, 243:1695-1699); a hydrophobic region; a hydrophilic region; or a free thiol which forms an intermolecular disulfide bond between the chimeric molecules of a homo- or heteromultimer. In addition, a multimerization domain can include an amino acid sequence comprising a protuberance complementary to an amino acid sequence comprising a hole, such as is described, for example, in U.S. Pat. No. 5,731,168; International Patent Pub. Nos. WO 98/50431 and WO 2005/063816; Ridgway et al. (1996) Protein Engineering, 9:617-621. Such a multimerization region can be engineered such that steric interactions not only promote stable interaction, but further promote the formation of heterodimers over homodimers from a mixture of chimeric monomers. Generally, protuberances are constructed by replacing small amino acid side chains from the interface of the first polypeptide with larger side chains (e.g., tyrosine or tryptophan). Compensatory cavities of identical or similar size to the protuberances are optionally created on the interface of the second polypeptide by replacing large amino acid side chains with smaller ones (e.g., alanine or threonine). Exemplary multimerization domains are described below.

The variant ICOSL polypeptide can be joined anywhere, but typically via its N- or C-terminus, to the N- or C-terminus of a multimerization domain to form a chimeric polypeptide. The linkage can be direct or indirect via a linker. Also, the chimeric polypeptide can be a fusion protein or can be formed by chemical linkage, such as through covalent or non-covalent interactions. For example, when preparing a chimeric polypeptide containing a multimerization domain, nucleic acid encoding all or part of a variant ICOSL polypeptide can be operably linked to nucleic acid encoding the multimerization domain sequence, directly or indirectly or optionally via a linker domain. In some cases, the construct encodes a chimeric protein where the C-terminus of the variant ICOSL polypeptide is joined to the N-terminus of the multimerization domain. In some instances, a construct can encode a chimeric protein where the N-terminus of the variant ICOSL polypeptide is joined to the N- or C-terminus of the multimerization domain.

A polypeptide multimer contains two chimeric proteins created by linking, directly or indirectly, two of the same or different variant ICOSL polypeptides directly or indirectly to a multimerization domain. In some examples, where the multimerization domain is a polypeptide, a gene fusion encoding the variant ICOSL polypeptide and multimerization domain is inserted into an appropriate expression vector. The resulting chimeric or fusion protein can be expressed in host cells transformed with the recombinant expression vector, and allowed to assemble into multimers, where the multimerization domains interact to form multivalent polypeptides. Chemical linkage of multimerization domains to variant ICOSL polypeptides can be effected using heterobifunctional linkers.

The resulting chimeric polypeptides, such as fusion proteins, and multimers formed therefrom, can be purified by any suitable method such as, for example, by affinity chromatography over Protein A or Protein G columns. Where two nucleic acid molecules encoding different polypeptides are transformed into cells, formation of homo- and heterodimers will occur. Conditions for expression can be adjusted so that heterodimer formation is favored over homodimer formation.

Immunoglobulin Domain

In some embodiments, the immunomodulatory protein comprises a variant ICOSL polypeptide attached to an Fc region of an immunoglobulin (yielding an "immunomodulatory Fc fusion," such as an "ICOSL-Fc variant fusion," also termed a ICOSL vIgD-Fc fusion). In some embodiments, the ICOSL-Fc variant fusion also comprises one or more additional IgSF domain(s), such as one or more additional vIgD linked to a vIgD of ICOSL. In some embodiments, the attachment of the variant ICOSL polypeptide or additional IgSF domain is at the N-terminus of the Fc. In some embodiments, the attachment of the variant ICOSL or additional IgSF domain polypeptide is at the C-terminus of the Fc. In some embodiments, two or more ICOSL or additional IgSF domain variant polypeptides (the same or different) are independently attached at the N-terminus and at the C-terminus.

In some embodiments, the Fc is murine or human Fc. In some embodiments, the Fc is a mammalian or human IgG1, lgG2, lgG3, or lgG4 Fc regions. In some embodiments, the Fc is derived from IgG1, such as human IgG1. In some embodiments, the Fc comprises the amino acid sequence set forth in SEQ ID NO: 226 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 226.

In some embodiments, the Fc region contains one more modifications to alter (e.g. reduce) one or more of its normal functions. In general, the Fc region is responsible for effector functions, such as complement-dependent cytotoxicity (CDC) and antibody-dependent cell cytotoxicity (ADCC), in addition to the antigen-binding capacity, which is the main function of immunoglobulins. Additionally, the FcRn sequence present in the Fc region plays the role of regulating the IgG level in serum by increasing the in vivo half-life by conjugation to an in vivo FcRn receptor. In some embodiments, such functions can be reduced or altered in an Fc for use with the provided Fc fusion proteins.

In some embodiments, one or more amino acid modifications may be introduced into the Fc region of an ICOSL-Fc variant fusion provided herein, thereby generating an Fc region variant. In some embodiments, the Fc region variant has decreased effector function. There are many examples of changes or mutations to Fc sequences that can alter effector function. For example, WO 2000/42072, WO2006/019447, WO2012/125850, WO2015/107026, US2016/0017041 and Shields et al. *J Biol. Chem.* 9(2): 6591-6604 (2001) describe exemplary Fc variants with improved or diminished binding to FcRs. The contents of those publications are specifically incorporated herein by reference.

In some embodiments, the provided variant ICOSL-Fc fusions comprise an Fc region that exhibits reduced effector functions (also called inert Fc or effectorless Fc), which makes it a desirable candidate for applications in which the half-life of the ICOSL-Fc variant fusion in vivo is important yet certain effector functions (such as CDC and ADCC) are unnecessary or deleterious. In vitro and/or in vivo cytotoxicity assays can be conducted to confirm the reduction/depletion of CDC and/or ADCC activities. For example, Fc receptor (FcR) binding assays can be conducted to ensure that the ICOSL-Fc variant fusion lacks FcγR binding (hence likely lacking ADCC activity), but retains FcRn binding ability. The primary cells for mediating ADCC, NK cells, express FcγRIII only, whereas monocytes express FcγRI, FcγRII and FcγRIII. FcR expression on hematopoietic cells is summarized in Table 3 on page 464 of Ravetch and Kinet, *Annu. Rev. Immunol.* 9:457-492 (1991). Non-limiting examples of in vitro assays to assess ADCC activity of a molecule of interest is described in U.S. Pat. No. 5,500,362 (see, e.g. Hellstrom, I. et al. *Proc. Nat'l Acad. Sci. USA* 83:7059-7063 (1986)) and Hellstrom, I et al., *Proc. Nat'l Acad. Sci. USA* 82:1499-1502 (1985); U.S. Pat. No. 5,821,337 (see Bruggemann, M. et al., *J. Exp. Med.* 166:1351-1361 (1987)). Alternatively, non-radioactive assay methods may be employed (see, for example, ACTI™ non-radioactive cytotoxicity assay for flow cytometry (CellTechnology, Inc. Mountain View, Calif.; and CytoTox 96™ non-radioactive cytotoxicity assay (Promega, Madison, Wis.). Useful effector cells for such assays include peripheral blood mononuclear cells (PBMC) and Natural Killer (NK) cells. Alternatively, or additionally, ADCC activity of the molecule of interest may be assessed in vivo, e.g., in an animal model such as that disclosed in Clynes et al. *Proc. Nat'l Acad. Sci. USA* 95:652-656 (1998). C1q binding assays may also be carried out to confirm that the ICOSL-Fc variant fusion is unable to bind C1q and hence lacks CDC activity. See, e.g., C1q and C3c binding ELISA in WO 2006/029879 and WO 2005/100402. To assess complement activation, a CDC assay may be performed (see, for example, Gazzano-Santoro et al., *J. Immunol. Methods* 202:163 (1996); Cragg, M. S. et al., *Blood* 101:1045-1052 (2003); and Cragg, M. S. and M. J. Glennie, *Blood* 103:2738-2743 (2004)). FcRn binding and in vivo clearance/half life determinations can also be performed using methods known in the art (see, e.g., Petkova, S. B. et al., *Int'l. Immunol.* 18(12):1759-1769 (2006)).

ICOSL-Fc variant fusions with reduced effector function include those with substitution of one or more of Fc region residues 238, 265, 269, 270, 297, 327 and 329 by EU numbering (U.S. Pat. No. 6,737,056). Such Fc mutants include Fc mutants with substitutions at two or more of amino acid positions 265, 269, 270, 297 and 327 by EU numbering, including the so-called "DANA" Fc mutant with substitution of residues 265 and 297 to alanine (U.S. Pat. No. 7,332,581).

In some embodiments, the Fc region of ICOSL-Fc variant fusions has an Fc region in which any one or more of amino acids at positions 234, 235, 236, 237, 238, 239, 270, 297, 298, 325, and 329 (indicated by EU numbering) are substituted with different amino acids compared to the native Fc region. Such alterations of Fc region are not limited to the above-described alterations, and include, for example, alterations such as deglycosylated chains (N297A and N297Q), IgG1-N297G, IgG1-L234A/L235A, IgG1-L234A/L235E/G237A, IgG1-A325A/A330S/P331S, IgG1-C226S/C229S, IgG1-C226S/C229S/E233P/L234V/L235A, IgG1-E233P/L234V/L235A/G236del/S267K, IgG1-L234F/L235E/P331S, IgG1-S267E/L328F, IgG2-V234A/G237A, IgG2-H268Q/V309L/A330S/A331S, IgG4-L235A/G237A/E318A, and IgG4-L236E described in Current Opinion in Biotechnology (2009) 20 (6), 685-691; alterations such as G236R/L328R, L235G/G236R, N325A/L328R, and N325LL328R described in WO 2008/092117; amino acid insertions at positions 233, 234, 235, and 237 (indicated by EU numbering); and alterations at the sites described in WO 2000/042072.

Certain Fc variants with improved or diminished binding to FcRs are described. (See, e.g., U.S. Pat. No. 6,737,056; WO 2004/056312, WO2006/019447 and Shields et al., *J. Biol. Chem.* 9(2): 6591-6604 (2001).)

In some embodiments, there is provided a ICOSL-Fc variant fusion comprising a variant Fc region comprising one or more amino acid substitutions which increase half-life and/or improve binding to the neonatal Fc receptor (FcRn). Antibodies with increased half-lives and improved binding to FcRn are described in US2005/0014934A1 (Hinton et al.) or WO2015107026. Those antibodies comprise an Fc region with one or more substitutions therein which improve binding of the Fc region to FcRn. Such Fc variants include those with substitutions at one or more of Fc region residues: 238, 256, 265, 272, 286, 303, 305, 307, 311, 312, 317, 340, 356, 360, 362, 376, 378, 380, 382, 413, 424 or 434 by EU numbering, e.g., substitution of Fc region residue 434 (U.S. Pat. No. 7,371,826).

In some embodiments, the Fc region of a ICOSL-Fc variant fusion comprises one or more amino acid substitution E356D and M358L by EU numbering. In some embodiments, the Fc region of a ICOSL-Fc variant fusion comprises one or more amino acid substitutions C220S, C226S, and/or C229S by EU numbering. In some embodiments, the Fc region of a ICOSL variant fusion comprises one or more amino acid substitutions R292C and V302C. See also Duncan & Winter, *Nature* 322:738-40 (1988); U.S. Pat. Nos. 5,648,260; 5,624,821; and WO 94/29351 concerning other examples of Fc region variants.

In some embodiments, the wild-type IgG1 Fc can be the Fc set forth in SEQ ID NO: 226 having an allotype containing residues Glu (E) and Met (M) at positions 356 and 358 by EU numbering (e.g., f allotype). In other embodiments, the wild-type IgG1 Fc contains amino acids of the human G1m1 allotype, such as residues containing Asp (D) and Leu (L) at positions 356 and 358, e.g. as set forth in SEQ ID NO: 927. Thus, in some cases, an Fc provided herein can contain amino acid substitutions E356D and M358L to reconstitute residues of allotype G1 m1 (e.g., alpha allotype). In some aspects, a wild-type Fc is modified by one or more amino acid substitutions to reduce effector activity or to render the Fc inert for Fc effector function. Exemplary effectorless or inert mutations include those described herein. Among effectorless mutations that can be included in an Fc of constructs provided herein are L234A, L235E and G237A by EU numbering. In some embodiments, a wild-type Fc is further modified by the removal of one or more cysteine residue, such as by replacement of the cysteine residues to a serine residue at position 220 (C220S) by EU numbering. Exemplary inert Fc regions having reduced effector function are set forth in SEQ ID NO: 633 or 477 and SEQ ID NO: 474 or 637, which are based on allotypes set forth in SEQ ID NO: 226 or SEQ ID NO: 927, respectively. In some embodiments, an Fc region used in a construct provided herein can further lack a C-terminal lysine residue.

In some embodiments, alterations are made in the Fc region that result in diminished C1q binding and/or Complement Dependent Cytotoxicity (CDC), e.g., as described in U.S. Pat. No. 6,194,551, WO 99/51642, and Idusogie et al., *J. Immunol.* 164: 4178-4184 (2000).

In some embodiments, there is provided a ICOSL-Fc variant fusion comprising a variant Fc region comprising one or more amino acid modifications, wherein the variant Fc region is derived from IgG1, such as human IgG1. In some embodiments, the variant Fc region is derived from the amino acid sequence set forth in SEQ ID NO: 226. In some embodiments, the Fc exhibits reduced effector function. In some embodiments, the Fc contains at least one amino acid substitution that is N82G by numbering of SEQ ID NO: 226 (corresponding to N297G by EU numbering). In some embodiments, the Fc further contains at least one amino acid substitution that is R77C or V87C by numbering of SEQ ID NO: 226 (corresponding to R292C or V302C by EU numbering). In some embodiments, the variant Fc region further comprises a C5S amino acid modification by numbering of SEQ ID NO: 226 (corresponding to C220S by EU numbering). For example, in some embodiments, the variant Fc region comprises the following amino acid modifications: V297G and one or more of the following amino acid modifications C220S, R292C or V302C by EU numbering (corresponding to N82G and one or more of the following amino acid modifications C5S, R77C or V87C with reference to SEQ ID NO:226), e.g. the Fc region comprises the sequence set forth in SEQ ID NO:476. In some embodiments, the variant Fc region comprises one or more of the amino acid modifications C220S, L234A, L235E or G237A, e.g. the Fc region comprises the sequence set forth in SEQ ID NO:477. In some embodiments, the variant Fc region comprises one or more of the amino acid modifications C220S, E233P, L234V, L235A, G236del or S267K, e.g. the Fc region comprises the sequence set forth in SEQ ID NO:478. In some embodiments, the variant Fc comprises one or more of the amino acid modifications C220S, L234A, L235E, G237A, E356D or M358L, e.g. the Fc region comprises the sequence set forth in SEQ ID NO:474.

In some embodiments, the Fc region lacks the C-terminal lysine corresponding to position 232 of the reference (e.g., unmodified) or wild-type Fc set forth in SEQ ID NO: 56 (corresponding to K447del by EU numbering). In some embodiments, because the C-terminal lysine may be differentially removed during biosynthesis, removal of the C-terminal lysine residue results in a more homogenous product when the protein is expressed in cells. In some aspects, such an Fc region can additionally include one or more additional modifications, e.g. amino acid substitutions, such as any as described. Exemplary of such an Fc region is set forth in SEQ ID NO: 632, 633, 634, or 637.

In some embodiments, there is provided a ICOSL-Fc variant fusion comprising a variant Fc region in which the variant Fc comprises the sequence of amino acids set forth in any of SEQ ID NOS:474, 476, 477, 478, 507, 632, 633, 634, or 637 or a sequence of amino acids that exhibits at least 85%, 86%, 87%, 88%, 89%, 90%, 91%, 92%, 93%, 94%, 95%, 96%, 97%, 98%, 99% or more sequence identity to any of SEQ ID NOS: 474, 476, 477, 478, 507, 632, 633, 634, or 637. In some embodiments, the Fc exhibits reduced effector function.

In some embodiments, the Fc is derived from IgG2, such as human IgG2. In some embodiments, the Fc comprises the amino acid sequence set forth in SEQ ID NO: 227 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 227.

In some embodiments, the Fc comprises the amino acid sequence set forth in SEQ ID NO: 505 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 505. In some embodiments, the IgG4 Fc is a stabilized Fc in which the CH3 domain of human IgG4 is substituted with the CH3 domain of human IgG1 and which exhibits inhibited aggregate formation, an antibody in which the CH3 and CH2 domains of human IgG4 are substituted with the CH3 and CH2 domains of human IgG1, respectively, or an antibody in which arginine at position 409 indicated in the EU index proposed by Kabat et al. of human IgG4 is substituted with lysine and which exhibits inhibited aggregate formation (see e.g. U.S. Pat. No. 8,911,726). In some embodiments, the Fc is an IgG4 containing the S228P mutation, which has been shown to prevent recombination between a therapeutic antibody and an endogenous IgG4 by Fab-arm exchange (see e.g. Labrijin et al. (2009) Nat. Biotechnol., 27(8) 767-71.) In some embodiments, the Fc comprises the amino acid sequence set forth in SEQ ID NO: 506 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO: 506.

In some embodiments, the variant ICOSL polypeptide is directly linked to the Fc sequence. In some embodiments, the variant ICOSL polypeptide is indirectly linked to the Fc sequence, such as via a linker. In some embodiments, one or more "peptide linkers" link the variant ICOSL polypeptide and the Fc domain. In some embodiments, a peptide linker can be a single amino acid residue or greater in length. In some embodiments, the peptide linker has at least one amino acid residue but is no more than 20, 19, 18, 17, 16, 15, 14, 13, 12, 11, 10, 9, 8, 7, 6, 5, 4, 3, 2, or 1 amino acid residues in length. In some embodiments, the linker is three alanines (AAA). In some embodiments, the linker is (in one-letter amino acid code): GGGGS ("4GS"; SEQ ID NO:636) or multimers of the 4GS linker, such as repeats of 2, 3, 4, 5 or 6 4GS linkers, such as set forth in SEQ ID NO: 229 (2×GGGGS) or SEQ ID NO: 228 (3×GGGGS). In some embodiments, the linker is a rigid linker. For example, the linker is an α-helical linker. In some embodiments, the linker is (in one-letter amino acid code): EAAAK or multimers of the EAAAK linker, such as repeats of 2, 3, 4, or 5 4GS linkers, such as set forth in SEQ ID NO: 629 (EAAAK) or SEQ ID NO: 630 (3×EAAAK) or SEQ ID NO: 631 (5×EAAAK). In some embodiments, linkers start with one or more EAAAK units and can be lengthened by addition of A, AA, AAA, AAAA, EAAAA and EAAAK sequences. In some embodiments, the linker can further include amino acids introduced by cloning and/or from a restriction site, for example the linker can include the amino acids GS (in one-letter amino acid code) as introduced by use of the restriction site BAMHI. In some embodiments, the linker (in one-letter amino acid code) is GSGGGGS (SEQ ID NO: 635). In some examples, the linker is a 2×GGGGS followed by three alanines (GGGGSGGGGSAAA; SEQ ID NO: 230).

In some embodiments, the variant ICOSL-Fc fusion protein is a dimer formed by two variant ICOSL Fc polypeptides linked to an Fc domain. In some specific embodiments, identical or substantially identical species (allowing for 3 or fewer N-terminus or C-terminus amino acid sequence differences) of ICOSL-Fc variant fusion polypeptides will be dimerized to create a homodimer. In some embodiments, the dimer is a homodimer in which the two variant ICOSL Fc polypeptides are the same. Alternatively, different species of ICOSL-Fc variant fusion polypeptides can be dimerized to yield a heterodimer. Thus, in some embodiments, the dimer is a heterodimer in which the two variant ICOSL Fc polypeptides are different.

In some embodiments, provided is a variant ICOSL-Fc fusion protein containing a variant ICOSL polypeptide that includes one or more amino acid modifications in a reference ICOSL as described in Section II that is linked, directly or indirectly, to an Fc region. In some cases, the C-terminus of the variant ICOSL polypeptide is joined to the N-terminus of the Fc region. In some embodiments, the variant ICOSL of an ICOSL-Fc fusion contains one or more amino acid modifications in the sequence of amino acids the reference IgV domain set forth in SEQ ID NO:545. In particular cases, such an immunomodulatory protein contains variant ICOSL polypeptide containing an IgV domain, such as an IgV domain set forth in any one of SEQ ID NOS: 197-199, 201-208, 210, 212, 240, 326-340, 382-386, 425-426, 434, 546-599, 686-857, 906-907, 909-910, or an IgV domain that has at least 85%, 86%, 87%, 88%, 89%, 90%, 91%, 92%, 93%, 94%, 95%, 96%, 97%, 98%, 99% to any of SEQ ID NOS: 197-199, 201-208, 210, 212, 240, 326-340, 382-386, 425-426, 434, 546-599, 686-857, 906-907, 909-910 and contains the one or more amino acid modifications of the respective SEQ ID NO. In some embodiments, the variant ICOSL polypeptide has an IgSF domain (e.g. IgV domain) that exhibits increased binding affinity to CD28 or ICOS, such as any of the amino acid modifications described herein. In some embodiments, the variant ICOSL polypeptide has an IgSF domain (e.g. IgV domain) containing one or more amino acid modification, e.g. substitution in an reference ICOSL or specific binding fragment, corresponding to position(s) 52, 57, or 100 with reference to numbering of SEQ ID NO: 32. In some embodiments, the variant ICOSL polypeptide has one or more amino acid modification, e.g. substitution selected from N52A, N52C, N52D, N52G, N52H, N52L, N52K, N52M, N52P, N52Q, N52R, N52S, N52T, N52V, N52Y, N57A, N57E, N57F, N57H, N57K, N57L, N57M, N57P, N57Q, N57S, N57T, N57V, N57W, N57Y, Q100A, Q100D, Q100E, Q100G, Q100K, Q100L, Q100M, Q100N, Q100R, Q100P, Q100S, Q100T, or Q100V. Exemplary of such variant molecules include any as described herein. In some embodiments, the variant ICOSL polypeptide contains the amino acid modifications N52H/N57Y/Q100R (e.g. is or includes an IgV domain set forth in SEQ ID NO: 565). In some embodiments, the variant ICOSL polypeptide contains the amino acid modifications N52D (e.g. is or includes an IgV domain set forth in SEQ ID NO: 548). In some embodiments, the variant ICOSL polypeptide contains the amino acid modifications N52H/Q100R (e.g. is or includes an IgV domain set forth in SEQ ID NO: 567). In some embodiments, the variant ICOSL polypeptide contains the amino acid modifications N52L/N57H/Q100R (e.g. is or includes an IgV domain set forth in SEQ ID NO: 761). In some embodiments, the variant ICOSL polypeptide contains the amino acid modifications N52H/N57Y/Q100P (e.g. is or includes an IgV domain set forth in SEQ ID NO: 570).

In particular embodiments of such variant ICOSL-Fc fusion proteins, the Fc polypeptide is a variant of a human IgG1 Fc region that exhibits reduced effector functions, such as any as described. In some embodiments, the Fc region is a human IgG1 that contains the amino acid modifications N297G, E233P/L234V/L235A/G236del/S267K or L234A/L235E/G237A, wherein the residue is numbered according to the EU index of Kabat. In some embodiments, the variant IgG1 Fc region further contains the amino acid substitution C220S, wherein the residues are numbered according to the EU index of Kabat. In some embodiments, the Fc region contains K447del, wherein the residue is numbered according to the EU index of Kabat. In some aspects, the Fc region contains the sequence of amino acid sequence set forth in any of SEQ ID NOS: 474, 476, 477, 478, 633 or 637 or a sequence of amino acids that exhibits at least 85%, 90%, 91%, 92%, 93%, 94%, 95%, 96%, 97%, 98%, 99% or more sequence identity to any of SEQ ID NOS: 474, 476, 477, 478, 633 or 637 and contains the amino acid substitutions of the respective SEQ ID NO. The linkage between the variant ICOSL IgSF (e.g. IgV) polypeptide and the Fc can be via a peptide linker, such as any as described. In some embodiments, the linker is GGGGS ("4GS"; SEQ ID NO: 636), SEQ ID NO: 229 (2×GGGGS) or SEQ ID NO: 228 (3×GGGGS). In particular examples, the C-terminus of the variant ICOSL polypeptide is joined to the N-terminus of the Fc region, such that the order of components is variant ICOSL-linker-Fc.

In some embodiments, there is provided a variant ICOSL-Fc fusion protein, e.g. variant ICOSL-linker-Fc, containing a variant ICOSL IgV domain set forth in SEQ ID NO:565, a linker set forth in SEQ ID NO:636 and an Fc polypeptide set forth in SEQ ID NO: 637. In some embodiments, there is provided a variant ICOSL-Fc fusion protein, e.g. variant ICOSL-linker-Fc, containing a variant ICOSL IgV domain set forth in SEQ ID NO:565, a linker set forth in SEQ ID NO:636 and an Fc polypeptide set forth in SEQ ID NO: 474.

In some embodiments, there is provided a variant ICOSL-Fc fusion protein, e.g. variant ICOSL-linker-Fc, containing a variant ICOSL IgV domain set forth in SEQ ID NO:565, a linker set forth in SEQ ID NO:636 and an Fc polypeptide set forth in SEQ ID NO: 477. In some embodiments, there is provided a variant ICOSL-Fc fusion protein, e.g. variant ICOSL-linker-Fc, containing a variant ICOSL IgV domain set forth in SEQ ID NO:565, a linker set forth in SEQ ID NO:636 and an Fc polypeptide set forth in SEQ ID NO: 633.

In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO: 229 and an Fc polypeptide set forth in SEQ ID NO: 637. In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO:229 and an Fc polypeptide set forth in SEQ ID NO: 474. In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO: 229 and an Fc polypeptide set forth in SEQ ID NO: 477. In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO:229 and an Fc polypeptide set forth in SEQ ID NO: 633.

In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO:228 and an Fc polypeptide set forth in SEQ ID NO: 637. In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO: 228 and an Fc polypeptide set forth in SEQ ID NO: 474. In some embodiments, there is provided a variant ICOSL-Fc fusion protein, e.g. variant ICOSL-linker-Fe, containing a variant ICOSL IgV domain set forth in SEQ ID NO:565, a linker set forth in SEQ ID NO:228 and an Fc polypeptide set forth in SEQ ID NO: 477. In some embodiments, there is provided a variant ICOSL-Fc fusion protein, e.g. variant ICOSL-linker-Fe, containing a variant ICOSL IgV domain set forth in SEQ ID NO: 565, a linker set forth in SEQ ID NO:228 and an Fc polypeptide set forth in SEQ ID NO: 633.

In some embodiments, there is provided a variant ICOSL IgSF Fc fusion protein that has the sequence of amino acids set forth in SEQ ID NO: 928, or a sequence of amino acids that exhibits at least 85%, 90%, 91%, 92%, 93%, 94%, 95%, 96%, 97%, 98%, 99% to SEQ ID NO:928. In some embodiments, the variant ICOSL IgSF Fc fusion protein binds to CD28 and ICOS, such as with increased binding affinity compared to reference (wild-type) ICOSL-Fc fusion protein. In some embodiments, the variant ICOSL IgSF Fc fusion exhibits reduced Fe effector function compared to fusion with an Fc of a wild-type human IgG1.

In some embodiments, there is provided a multi-domain stack immunomodulatory protein in which two or more IgSF domain, including a vIgD of ICOSL and one or more additional IgSF domain (e.g. second variant IgSF domain) from another IgSF family member, are linked or attached to an Fc to form an Fc fusion, which, upon expression in a cell can, in some aspects, produce a dimeric multi-domain stack immunomodulatory protein. Thus, also provided are dimeric multi-domain immunomodulatory proteins.

In some embodiments, the variant ICOSL polypeptide and one or more additional IgSF domain are independently linked, directly or indirectly, to the N- or C-terminus of an Fc region. In some embodiments, the variant ICOSL polypeptide and at least one of the one or more additional IgSF domain are linked, directly or indirectly, and one of the variant ICOSL or and one of the one or more additional IgSF domain is also linked, directly or indirectly, to the N- or C-terminus of an Fc region. In some embodiments, the N- or C-terminus of the Fc region is linked to the variant ICOSL polypeptide or the one or more additional IgSF domain and the other of the N- or C-terminus of the Fc region is linked to the other of the ICOSL variant or another of the one or more additional IgSF domain. In some embodiments, linkage to the Fc is via a peptide linker, e.g. a peptide linker, such as described above. In some embodiments, linkage between the variant ICOSL and second IgSF domain is via a peptide linker, e.g. a peptide linker, such as described above. In some embodiments, linkage between the variant ICOSL and the one or more additional IgSF domain is via a peptide linker, e.g., a peptide linker, such as described above. In some embodiments, the vIgD of ICOSL, the one or more additional IgSF domains, and the Fc domain can be linked together in any of numerous configurations as depicted in FIGS. 16A and 16B. In some embodiments, the ICOSL-Fc variant fusion can further contain a signal peptide, such as an exemplary signal peptide as contained in the sequence of amino acids set forth in SEQ ID NO: 59 or 225. Exemplary configurations are described in the Examples.

In some embodiments, the stacked immunomodulatory protein is a dimer formed by two immunomodulatory Fc fusion polypeptides. Also provided are nucleic acid molecules encoding any of the stacked immunomodulatory proteins. In some embodiments, the dimeric multi-domain stack immunomodulatory protein can be produced in cells by expression, or in some cases co-expression, of stack immunomodulatory Fc region polypeptides, such as described further below.

In some embodiments, the dimeric multi-domain stack immunomodulatory protein is divalent for each Fc subunit, monovalent for each subunit, or divalent for one subunit and tetravalent for the other.

In some embodiments, the dimeric multi-domain stack immunomodulatory protein is a homodimeric multi-domain stack Fc protein. In some embodiments, the dimeric multi-domain stack immunomodulatory protein comprises a first stack immunomodulatory Fc fusion polypeptide and a second stack immunomodulatory Fc fusion polypeptide in which the first and second polypeptide are the same. In some embodiments, the Fc portion of the polypeptide can be any Fc as described above.

In some embodiments, the multi-domain stack molecule contains a first Fc fusion polypeptide containing a variant ICOSL and a second fusion IgSF domain and a second Fc polypeptide containing the variant ICOSL and the second IgSF domain. In some embodiments, the multi-domain stack molecule contains a first Fc fusion polypeptide containing a variant ICOSL and a second IgSF domain, and a third IgSF domain and a second Fc fusion polypeptide containing the variant ICOSL, the second IgSF domain, and the third IgSF domain. In some embodiments, the Fc portion of the first and/or second fusion polypeptide can be any Fc as described above. In some embodiments, the Fc portion or region of the first and second fusion polypeptide is the same.

In some embodiments, there is provided an immunomodulatory protein that is a ICOSL-NKp30 multi-domain stack containing any of the variant ICOSL polypeptides and one or more IgF domains of NKp30, e.g. wild-type or unmodified NKp30, such as an IgV domain set forth in SEQ ID NO: 929 or an ECD or a binding portion thereof set forth in SEQ ID NO: 215 or a binding portion thereof. In some embodiments, there is provided an immunomodulatory protein containing any of the variant ICOSL polypeptide and one or more IgSF domains of a variant NKp30 containing one or more amino acid modifications in the wild-type or unmodified sequence set forth in SEQ ID NO: 215 or 929. In some embodiments, the one or more amino acid modifications (e.g. substitutions) include one or more of L30V, A60V, S64P, S86G, such as 1, 2, 3 or 4 of such amino acid modifications. In some aspects, a variant NKp30 of the multi-domain stack polypeptides is or includes a variant IgV domain, such as a variant IgV domain set forth in any of SEQ ID NOS: 504, 930, 931, 932 or 933, or an IgV domain that has at least 85%, 86%, 87%, 88%, 89%, 90%, 91%, 92%, 93%, 94%, 95%, 96%, 97%, 98%, 99% to any of SEQ ID NOS:504, 930, 931, 932 or 933 and contains the one or more amino acid modifications of the respective SEQ ID NO. In some aspects, a variant NKp30 of the multi-domain stack polypeptides is or includes a variant ECD domain, such as a variant ECD set forth in any of SEQ ID NOS: 215, 216, 217, 218 or 219, or an ECD domain that has at least 85%, 86%, 87%, 88%, 89%, 90%, 91%, 92%, 93%, 94%, 95%, 96%, 97%, 98%, 99% to any of SEQ ID NOS: 215, 216, 217, 218 or 219 and contains the one or more amino acid modifications of the respective SEQ ID NO.

In any of such embodiments of an ICOSL-NKp30 multi-domain stack, the variant ICOSL polypeptide can include any described in Section II containing a variant IgSF domain (e.g. IgV or ECD), such as including any of the amino acid modifications set forth in a Table 1. In some cases, such an immunomodulatory protein contains a variant ICOSL polypeptide containing an ECD domain, such as an ECD domain set forth in any one of SEQ ID NOS: 109-142, 239, 280-325, 364-381, 387-424, 427-433, 435-470, 638-685, 905, 908, or an ECD domain that has at least 85%, 86%, 87%, 88%, 89%, 90%, 91%, 92%, 93%, 94%, 95%, 96%, 97%, 98%, 99% to any of SEQ ID NOS: 109-142, 239, 280-325, 364-381, 387-424, 427-433, 435-470, 638-685, 905, 908 and contains the one or more amino acid modifications of the respective SEQ ID NO. In particular cases, such an immunomodulatory protein contains a variant ICOSL polypeptide containing an IgV domain, such as an IgV domain set forth in any one of SEQ ID NOS: 197-199, 201-208, 210, 212, 240, 326-340, 382-386, 425-426, 434, 546-599, 686-857, 906-907, 909-910, or an IgV domain that has at least 85%, 86%, 87%, 88%, 89%, 90%, 91%, 92%, 93%, 94%, 95%, 96%, 97%, 98%, 99% to any of SEQ ID NOS: 197-199, 201-208, 210, 212, 240, 326-340, 382-386, 425-426, 434, 546-599, 686-857, 906-907, 909-910 and contains the one or more amino acid modifications of the respective SEQ ID NO. In some embodiments, the variant ICOSL polypeptide has an IgSF domain (e.g. IgV domain) exhibits increased binding affinity to CD28 or ICOS, such as any described herein. In some embodiments, the variant ICOSL polypeptide has an IgSF domain (e.g. IgV domain) containing one or more amino acid modification, e.g. substitution in an reference ICOSL or specific binding fragment, corresponding to position(s) 52, 57, or 100 with reference to numbering of SEQ ID NO:32. In some embodiments, the variant ICOSL polypeptide has one or more amino acid modification, e.g. substitution selected from N52A, N52C, N52D, N52G, N52H, N52L, N52K, N52M, N52P, N52Q, N52R, N52S, N52T, N52V, N52Y, N57A, N57E, N57F, N57H, N57K, N57L, N57M, N57P, N57Q, N57S, N57T, N57V, N57W, N57Y, Q100A, Q100D, Q100E, Q100G, Q100K, Q100L, Q100M, Q100N, Q100R, Q100P, Q100S, Q100T, or Q100V. Exemplary of such variant molecules include any as described herein. In some embodiments, the variant ICOSL polypeptide contains the amino acid modifications N52D (e.g. is or includes an IgV domain set forth in SEQ ID NO:548), N52H/Q100R (e.g. is or includes an IgV domain set forth in SEQ ID NO:567), N52H/N57Y/Q100R (e.g. is or includes an IgV domain set forth in SEQ ID NO:565), or N52L/N57H/Q100R (e.g. is or includes an IgV domain set forth in SEQ ID NO:761).

In some embodiments, the provided multi-domain stack immunomodulatory proteins, such as an ICOSL-NKp30 multi-domain stack immunomodulatory protein, are fused to an Fc polypeptide. In particular embodiments, the Fc polypeptide is a variant of a human IgG1 Fc region that exhibits reduced effector functions, such as any as described. In some embodiments, the Fc region is a human IgG1 that contains the amino acid modifications N297G, E233P/L234V/L235A/G236del/S267K or L234A/L235E/G237A, wherein the residue is numbered according to the EU index of Kabat. In some embodiments, the variant IgG1 Fc region further contains the amino acid substitution C220S, wherein the residues are numbered according to the EU index of Kabat. In some embodiments, the Fc region contains K447del, wherein the residue is numbered according to the EU index of Kabat. In some aspects, the Fc region contains the sequence of amino acid sequence set forth in any of SEQ ID NOS: 474, 476, 477, 478, 633 or 637 or a sequence of amino acids that exhibits at least 90%, 91%, 92%, 93%, 94%, 95%, 96%, 97%, 98%, 99% or more sequence identity to any of SEQ ID NOS: 474, 476, 477, 478, 633 or 637 and contains the amino acid substitutions of the respective SEQ ID NO.

Exemplary of such configurations are set forth in FIGS. 16A-16B and described herein. In some embodiments, any of the provided ICOSL-NKp30 multi-domain stack immunomodulatory polypeptides can contain two copies of a polypeptide having the structure: variant ICOSL IgSF (e.g. IgV, such as set forth in SEQ ID NO: 548, 565, 567 or 761)-linker 1-variant NKp30 IgSF (e.g. IgV, such as set forth in SEQ ID NO: 504)-linker 2-Fc. In some embodiments, any of the provided ICOSL-NKp30 multi-domain stack immunomodulatory polypeptides can contain two copies of a polypeptide having the structure: variant ICOSL IgSF (e.g. IgV, such as set forth in SEQ ID NO: 548, 565, 567 or 761)-linker 1-variant NKp30 IgSF (e.g. IgV, such as set forth in SEQ ID NO:504)-linker 1-variant NKp30 IgSF (e.g. IgV, such as set forth in SEQ ID NO:504)-linker 2-Fc. In some embodiments, linker 1 and linker 2 are peptide linkers, such as any as described. In some embodiments, linker 1 and linker 2 are the same. In some embodiments, linker 1 and linker 2 are different. In some embodiments, linker 1 is 3×GGGGS (SEQ ID NO: 228). In some embodiments, linker 2 is GSGGGS (SEQ ID NO: 635).

Exemplary ICOSL-NKp30 multidomain stacks have the sequence of amino acids set forth in any of SEQ ID NOS: 912, 914, 916, 918, 920, 922, 924 or 926, or a sequence of amino acids that exhibits at least 85%, 86%, 87%, 88%, 89%, 90%, 91%, 92%, 93%, 94%, 95%, 96%, 97%, 98%, 99% to any of SEQ ID NOS: 912, 914, 916, 918, 920, 922, 924 or 926.

In some embodiments, any of the provided ICOSL-NKp30 multi-domain stack immunomodulatory proteins bind to ICOS and/or CD28 and bind to B7-H6. In some embodiments, the provided ICOSL-NKp30 multi-domain stack immunomodulatory proteins provide for a binding molecule capable of tumor localization adjacent to an immune cell that expresses ICOS and/or CD28 (e.g. a T cell). In some embodiments, such ICOSL-NKp30 multidomain stack immunomodulatory proteins can be used to increase an immune response by engagement of ICOS and/or CD28 costimulatory receptors on T cells in a tumor microenvironment. In some cases, such ICOSL-NKp30 multi-domain stack immunomodulatory proteins, or pharmaceutical compositions thereof, can be used to treat a tumor or cancer.

In some embodiments, the multi-domain stack molecule is heterodimeric, comprising two different Fc fusion polypeptides, e.g. a first and a second Fc polypeptide, wherein at least one is an Fc fusion polypeptide containing at least one variant ICOSL polypeptide and/or at least one is an Fc polypeptide containing a second IgSF domain (e.g. second variant IgSF domain). In some embodiments, the first or second Fc fusion polypeptide further contains a third IgSF domain (e.g. third variant IgSF domain). In some embodiments, the multi-domain stack molecule contains a first Fc fusion polypeptide containing a variant ICOSL and a second Fc fusion polypeptide containing at a second IgSF domain, in which, in some cases, the first or second Fc fusion polypeptide additionally contains a third IgSF domain. In some embodiments, the multi-domain stack molecule contains a first Fc fusion polypeptide containing a variant ICOSL, a second IgSF domain, and in some cases, a third IgSF domain and a second Fc fusion polypeptide that is not linked to either a variant ICOSL polypeptide or an additional IgSF domain. In some embodiments, the Fc portion or region of the first and second fusion polypeptide is the same. In some embodiments, the Fc portion or region of the first and second fusion polypeptide is different. In some embodiments, the multi-domain stack molecule contains a first fusion Fc polypeptide containing 1, 2, 3, 4 or more variant ICOSL polypeptides and/or 1, 2, 3, 4 or more additional IgSF domains, wherein the total number of IgSF domains in the first stack Fc fusion polypeptide is greater than 2, 3, 4, 5, 6 or more. In one example of such an embodiment, the second stack Fc fusion polypeptide contains 1, 2, 3, 4 or more variant ICOSL polypeptides and/or 1, 2, 3, 4 or more second IgSF domains, wherein the total number of IgSF domains in the second stack Fc fusion polypeptide is greater than 2, 3, 4, 5, 6 or more. In another example of such an embodiment, the second Fc fusion polypeptide is not linked to either a variant ICOSL polypeptide or additional IgSF domain.

In some embodiments, the heterodimeric stack molecule contains a first stack immunomodulatory Fc fusion polypeptide and a second stack immunomodulatory Fc fusion polypeptide in which the first and second polypeptide are different. In some embodiments, a heterodimeric stack molecule contains a first Fc polypeptide fusion containing an Fc region and a first variant ICOSL polypeptide and/or second IgSF domain (e.g. second variant IgSF domain) and a second Fc polypeptide fusion containing an Fc region and the other of the first variant ICOSL polypeptide or the second IgSF domain. In some embodiments, a heterodimeric stack molecule contains a first Fc polypeptide fusion containing an Fc region and a first variant ICOSL polypeptide and/or second IgSF domain (e.g. second variant IgSF domain) and a second Fc polypeptide fusion containing both the first variant ICOSL polypeptide and second IgSF domain (e.g. second variant IgSF domain) but in a different orientation or configuration from the first Fc region. In some embodiments, the first and/or second Fc fusion polypeptide also contains a third IgSF domain (e.g. third variant IgSF domain).

In some embodiments, the Fc domain of one or both of the first and second stacked immunomodulatory Fc fusion polypeptide comprises a modification (e.g. substitution) such that the interface of the Fc molecule is modified to facilitate and/or promote heterodimerization. In some embodiments, modifications include introduction of a protuberance (knob) into a first Fc polypeptide and a cavity (hole) into a second Fc polypeptide such that the protuberance is positionable in the cavity to promote complexing of the first and second Fc-containing polypeptides. Amino acids targeted for replacement and/or modification to create protuberances or cavities in a polypeptide are typically interface amino acids that interact or contact with one or more amino acids in the interface of a second polypeptide.

In some embodiments, a sequence of amino acids is added preceding the Fc sequence for constructs in which the Fc sequence is the N-terminal portion of the sequence. In some cases, the sequence of amino acids HMSSVSAQ (SEQ ID NO:475) is added immediately preceding the Fc sequence for constructs in which the Fc sequence is the N-terminal portion of the sequence. In some embodiments, a heterodimeric stack molecule contains a first Fc polypeptide fusion containing an Fc region (knob) and a first variant ICOSL polypeptide and/or second IgSF domain (e.g. second variant IgSF domain) and a second Fc polypeptide fusion containing an Fc region (hole) and a stuffer sequence HMSSVSAQ (SEQ ID NO:475) added immediately preceding both Fc regions of the first and second Fc polypeptide fusion.

In some embodiments, a first polypeptide that is modified to contain protuberance (hole) amino acids include replacement of a native or original amino acid with an amino acid that has at least one side chain which projects from the interface of the first polypeptide and is therefore positionable in a compensatory cavity (hole) in an adjacent interface of a second polypeptide. Most often, the replacement amino acid is one which has a larger side chain volume than the original amino acid residue. One of skill in the art knows how to determine and/or assess the properties of amino acid residues to identify those that are ideal replacement amino acids to create a protuberance. In some embodiments, the replacement residues for the formation of a protuberance are naturally occurring amino acid residues and include, for example, arginine (R), phenylalanine (F), tyrosine (Y), or tryptophan (W). In some examples, the original residue identified for replacement is an amino acid residue that has a small side chain such as, for example, alanine, asparagine, aspartic acid, glycine, serine, threonine, or valine.

In some embodiments, a second polypeptide that is modified to contain a cavity (hole) is one that includes replacement of a native or original amino acid with an amino acid that has at least one side chain that is recessed from the interface of the second polypeptide and thus is able to accommodate a corresponding protuberance from the interface of a first polypeptide. Most often, the replacement amino acid is one which has a smaller side chain volume than the original amino acid residue. One of skill in the art knows how to determine and/or assess the properties of amino acid residues to identify those that are ideal replacement residues for the formation of a cavity. Generally, the replacement residues for the formation of a cavity are naturally occurring amino acids and include, for example, alanine (A), serine (S), threonine (T) and valine (V). In some examples, the original amino acid identified for replacement is an amino acid that has a large side chain such as, for example, tyrosine, arginine, phenylalanine, or tryptophan.

The CH3 interface of human IgG1, for example, involves sixteen residues on each domain located on four anti-parallel β-strands which buries 1090 Å2 from each surface (see e.g., Deisenhofer et al. (1981) Biochemistry, 20:2361-2370;

Miller et al., (1990) J Mol. Biol., 216, 965-973; Ridgway et al., (1996) Prot. Engin., 9: 617-621; U.S. Pat. No. 5,731,168). Modifications of a CH3 domain to create protuberances or cavities are described, for example, in U.S. Pat. No. 5,731,168; International Patent Applications WO98/50431 and WO 2005/063816; and Ridgway et al., (1996) Prot. Engin., 9: 617-621. In some examples, modifications of a CH3 domain to create protuberances or cavities are typically targeted to residues located on the two central anti-parallel β-strands. The aim is to minimize the risk that the protuberances which are created can be accommodated by protruding into the surrounding solvent rather than being accommodated by a compensatory cavity in the partner CH3 domain.

In some embodiments, the heterodimeric molecule contains a T366W mutation in the CH3 domain of the "knobs chain" and T366S, L368A, Y407V mutations in the CH3 domain of the "hole chain". In some cases, an additional interchain disulfide bridge between the CH3 domains can also be used (Merchant, A. M., et al., Nature Biotech. 16 (1998) 677-681) e.g. by introducing a Y349C mutation into the CH3 domain of the "knobs" or "hole" chain and a E356C mutation or a S354C mutation into the CH3 domain of the other chain. In some embodiments, the heterodimeric molecule contains S354C, T366W mutations in one of the two CH3 domains and Y349C, T366S, L368A, Y407V mutations in the other of the two CH3 domains. In some embodiments, the heterodimeric molecule comprises E356C, T366W mutations in one of the two CH3 domains and Y349C, T366S, L368A, Y407V mutations in the other of the two CH3 domains. In some embodiments, the heterodimeric molecule comprises Y349C, T366W mutations in one of the two CH3 domains and E356C, T366S, L368A, Y407V mutations in the other of the two CH3 domains. In some embodiments, the heterodimeric molecule comprises Y349C, T366W mutations in one of the two CH3 domains and S354C, T366S, L368A, Y407V mutations in the other of the two CH3 domains. Examples of other knobs-in-holes technologies are known in the art, e.g. as described by EP 1 870 459 A1.

In some embodiments, the Fc regions of the heterodimeric molecule additionally can contain one or more other Fc mutation, such as any described above. In some embodiments, the heterodimer molecule contains an Fc region with a mutation that reduces effector function.

In some embodiments, an Fc variant containing CH3 protuberance(knob) or cavity(hole) modifications can be joined to a stacked immunomodulatory polypeptide anywhere, but typically via its N- or C-terminus, to the N- or C-terminus of a first and/or second stacked immunomodulatory polypeptide, such as to form a fusion polypeptide. The linkage can be direct or indirect via a linker. Typically, a knob and hole molecule is generated by co-expression of a first stacked immunomodulatory polypeptide linked to an Fc variant containing CH3 protuberance modification(s) with a second stacked immunomodulatory polypeptide linked to an Fc variant containing CH3 cavity modification(s).

Also provided are nucleic acid molecules encoding the variant ICOSL-Fc fusion protein. In some embodiments, for production of an Fc fusion protein, a nucleic acid molecule encoding a variant ICOSL-Fc fusion protein is inserted into an appropriate expression vector. The resulting variant ICOSL-Fc fusion protein can be expressed in host cells transformed with the expression where assembly between Fc domains occurs by interchain disulfide bonds formed between the Fc moieties to yield dimeric, such as divalent, variant ICOSL-Fc fusion proteins.

The resulting Fc fusion proteins can be easily purified by affinity chromatography over Protein A or Protein G columns. For the generation of heterodimers, additional steps for purification can be necessary. For example, where two nucleic acids encoding different variant ICOSL polypeptides are transformed into cells, the formation of heterodimers must be biochemically achieved since variant ICOSL molecules carrying the Fc-domain will be expressed as disulfide-linked homodimers as well. Thus, homodimers can be reduced under conditions that favor the disruption of inter-chain disulfides, but do no effect intra-chain disulfides. In some cases, different variant-ICOSL Fc monomers are mixed in equimolar amounts and oxidized to form a mixture of homo- and heterodimers. The components of this mixture are separated by chromatographic techniques. Alternatively, the formation of this type of heterodimer can be biased by genetically engineering and expressing Fc fusion molecules that contain a variant ICOSL polypeptide using knob-into-hole methods described below.

B. Conjugates and Fusions of Variant Polypeptides and Immunomodulatory Proteins

In some embodiments, the variant polypeptides provided herein, which are immunomodulatory proteins comprising variants of an Ig domain of the IgSF family (vIgD), can be conjugated with, such as fused directly or indirectly, to, a moiety, such as an effector moiety, such as another protein, directly or indirectly, to form a conjugate ("IgSF conjugate"). In some embodiments, a variant ICOSL immunomodulatory protein is provided as a conjugate in which is contained a vIgD of ICOSL linked, directly or indirectly, to a targeting agent or moiety, e.g. to an antibody or other binding molecules that specifically binds to a ligand, e.g. an antigen, for example, for targeting or localizing the vIgD to a specific environment or cell, such as when administered to a subject. In some embodiments, the targeting agent, e.g. antibody or other binding molecule, binds to a tumor antigen, thereby localizing the variant ICOSL containing the vIgD to the tumor microenvironment, for example, to modulate activity of tumor infiltrating lymphocytes (TILs) specific to the tumor microenvironment. In some embodiments, the attachment can be covalent or non-covalent, e.g., via a biotin-streptavidin non-covalent interaction. In some embodiments, the conjugate is a fusion protein of a variant ICOSL polypeptide linked, directly or via a linker, to another protein or polypeptide moiety.

In some embodiments the fusion protein is an ICOSL-Fc variant fusion, in which any two or more of the foregoing variant polypeptides can be attached to an Fc.

In some embodiments, the IgSF conjugate, such as fusion protein, comprises the ECD of a wildtype (full length or truncated) or a variant ICOSL polypeptide. In some embodiments, the IgSF conjugate, such as fusion protein, comprises an IgV domain or an IgC (e.g., IgC2) domain or domains, or a specific binding fragment of the IgV domain or a specific binding fragment of the IgC (e.g., IgC2) domain or domains. In some embodiments, the IgSF conjugate, such as fusion protein, comprises an IgV domain of ICOSL as set forth in SEQ ID NOs: 196 or 545.

In some embodiments, the moiety can be a targeting moiety, a small molecule drug (non-polypeptide drug of less than 500 daltons molar mass), a toxin, a cytostatic agent, a cytotoxic agent, an immunosuppressive agent, a radioactive agent suitable for diagnostic purposes, a radioactive metal ion for therapeutic purposes, a prodrug-activating enzyme, an agent that increases biological half-life, or a diagnostic or detectable agent.

In some embodiments the effector moiety is a therapeutic agent, such as a cancer therapeutic agent, which is either cytotoxic, cytostatic or otherwise provides some therapeutic benefit. In some embodiments, the effector moiety is a targeting moiety or agent, such as an agent that targets a cell surface antigen, e.g., an antigen on the surface of a tumor cell. In some embodiments, the effector moiety is a label, which can generate a detectable signal, either directly or indirectly. In some embodiments, the effector moiety is a toxin. In some embodiments, the effector moiety is a protein, peptide, nucleic acid, small molecule or nanoparticle.

In some embodiments, 1, 2, 3, 4, 5 or more effector moieties, which can be the same or different, are conjugated, linked or fused to the variant polypeptide or protein to form an IgSF conjugate. In some embodiments, such effector moieties can be attached to the variant polypeptide or immunomodulatory protein using various molecular biological or chemical conjugation and linkage methods known in the art and described below. In some embodiments, linkers such as peptide linkers, cleavable linkers, non-cleavable linkers or linkers that aid in the conjugation reaction, can be used to link or conjugate the effector moieties to the variant polypeptide or immunomodulatory protein.

In some embodiments, the IgSF conjugate comprises the following components: (protein or polypeptide), $(L)_q$ and (effector moiety)$_m$, wherein the protein or polypeptide is any of the described variant polypeptides or immunomodulatory proteins capable of binding one or more cognate counter structure ligands as described; L is a linker for linking the protein or polypeptide to the moiety; m is at least 1; q is 0 or more; and the resulting IgSF conjugate binds to the one or more counter structure ligands. In particular embodiments, m is 1 to 4 and q is 0 to 8. In some embodiments, the linker is a peptide. In some embodiments, the effector moiety is a protein or polypeptide.

In some embodiments, there is provided an IgSF conjugate comprising a variant polypeptide or immunomodulatory protein provided herein conjugated with a targeting agent that binds to a cell surface molecule, for example, for targeted delivery of the variant polypeptide or immunomodulatory protein to a specific cell. In some embodiments, the targeting agent is a molecule(s) that has the ability to localize and bind to a molecule present on a normal cell/tissue and/or tumor cell/tumor in a subject. In other words, IgSF conjugates comprising a targeting agent can bind to a ligand (directly or indirectly), which is present on a cell, such as a tumor cell. The targeting agents of the invention contemplated for use include antibodies, polypeptides, peptides, aptamers, other ligands, or any combination thereof, that can bind a component of a target cell or molecule.

In some embodiments, the targeting agent binds a tumor cell(s) or can bind in the vicinity of a tumor cell(s) (e.g., tumor vasculature or tumor microenvironment) following administration to the subject. The targeting agent may bind to a receptor or ligand on the surface of the cancer cell. In another aspect of the invention, a targeting agent is selected which is specific for a noncancerous cells or tissue. For example, a targeting agent can be specific for a molecule present normally on a particular cell or tissue. Furthermore, in some embodiments, the same molecule can be present on normal and cancer cells. Various cellular components and molecules are known. For example, if a targeting agent is specific for EGFR, the resulting IgSF conjugate can target cancer cells expressing EGFR as well as normal skin epidermal cells expressing EGFR. Therefore, in some embodiments, an IgSF conjugate of the invention can operate by two separate mechanisms (targeting cancer and non-cancer cells).

In various aspects of the invention disclosed herein an IgSF conjugate of the invention comprises a targeting agent which can bind/target a cellular component, such as a tumor antigen, a bacterial antigen, a viral antigen, a mycoplasma antigen, a fungal antigen, a prion antigen, an antigen from a parasite. In some aspects, a cellular component, antigen or molecule can each be used to mean, a desired target for a targeting agent. For example, in various embodiments, a targeting agent is specific for or binds to a component, which includes but is not limited to, epidermal growth factor receptor (EGFR, ErbB-1, HER1), ErbB-2 (HER2/neu), ErbB-3/HER3, ErbB-4/HER4, EGFR ligand family; insulin-like growth factor receptor (IGFR) family, IGF-binding proteins (IGFBPs), IGFR ligand family; platelet derived growth factor receptor (PDGFR) family, PDGFR ligand family; fibroblast growth factor receptor (FGFR) family, FGFR ligand family, vascular endothelial growth factor receptor (VEGFR) family, VEGF family; HGF receptor family; TRK receptor family; ephrin (EPH) receptor family; AXL receptor family; leukocyte tyrosine kinase (LTK) receptor family; TIE receptor family, angiopoietin 1,2; receptor tyrosine kinase-like orphan receptor (ROR) receptor family, e.g. ROR1; CD171 (L1CAM); B7-H6 (NCR3LG1); PD-L1, tumor glycosylation antigen, e.g. sTn or Tn, such as sTn Ag of MUC1; LHR (LHCGR); phosphatidylserine, discoidin domain receptor (DDR) family; RET receptor family; KLG receptor family; RYK receptor family; MuSK receptor family; Transforming growth factor-α (TGF-α) receptors, TGF-β; Cytokine receptors, Class I (hematopoietin family) and Class II (interferon/IL-10 family) receptors, tumor necrosis factor (TNF) receptor superfamily (TNFRSF), death receptor family; cancer-testis (CT) antigens, lineage-specific antigens, differentiation antigens, alpha-actinin-4, ARTC1, breakpoint cluster region-Abelson (Bcr-ab1) fusion products, B-RAF, caspase-5 (CASP-5), caspase-8 (CASP-8), β-catenin (CTNNB1), cell division cycle 27 (CDC27), cyclin-dependent kinase 4 (CDK4), CDKN2A, COA-I, dek-can fusion protein, EFTUD-2, Elongation factor 2 (ELF2), Ets variant gene 6/acute myeloid leukemia 1 gene ETS (ETC6-AML1) fusion protein, fibronectin (FN), e.g. the extradomain A (EDA) of fibronectin, GPNMB, low density lipid receptor/GDP-L fucose: β-D-galactose 2-α-L-fucosyltransferase (LDLR/FUT) fusion protein, HLA-A2. arginine to isoleucine exchange at residue 170 of the α-helix of the α2-domain in the HLA-A2gene (HLA-A*201-R170I), HLA-A11, heat shock protein 70-2 mutated (HSP70-2M), K1AA0205, MART2, melanoma ubiquitous mutated 1, 2, 3 (MUM-I, 2, 3), prostatic acid phosphatase (PAP), neo-PAP, Myosin class I, NFYC, OGT, OS-9, pm1-RARα fusion protein, PRDX5, PTPRK, K-ras (KRAS2), N-ras (NRAS), HRAS, RBAF600, SIRT2, SNRPD1, SYT-SSX1 or -SSX2 fusion protein, Triosephosphate Isomerase, BAGE, BAGK-1, BAGE-2,3,4,5, GAGE-1,2,3,4,5,6,7,8, GnT-V (aberrant N-acetyl glucosaminyl transferase V, MGAT5), HERV-K-MEL, KK-LC, KM-HN-I, LAGE, LAGE-I, CTL-recognized antigen on melanoma (CAMEL), MAGE-A1 (MAGE-I), MAGE-A2, MAGE-A3, MAGE-A4, MAGE-A5, MAGE-A6, MAGE-A8, MAGE-A9, MAGE-A1O, MAGE-AI 1, MAGE-A12, MAGE-3, MAGE-B1, MAGE-B2, MAGE-B5, MAGE-B6, MAGE-C1, MAGE-C2, mucin 1 (MUC1), MART-1/Melan-A (MLANA), gp100, gp100/Pmell7 (SILV), tyrosinase (TYR), TRP-I, HAGE, NA-88, NY-ESO-I, NY-ESO-1/LAGE-2, SAGE, Sp17, SSX-1,2,3,4, TRP2-INT2, carcino-embryonic antigen (CEA), Kallikrein 4, mammaglobin-A, OA1, prostate specific antigen (PSA), TRP-1/gp75, TRP-2, adipophilin, interferon inducible protein absent in melanoma 2 (AIM-2), BING-4, CPSF, cyclin D1, epithelial cell adhesion molecule (Ep-CAM), EphA3, fibroblast growth factor-5 (FGF-5), glycoprotein 250 (gp250), EGFR (ERBB1), HER-2/neu (ERBB2), interleukin 13 receptor α2 chain (IL13Rα2), IL-6 receptor, intestinal carboxyl esterase (iCE), alpha-feto protein (AFP), M-CSF, mdm-2, MUC1, p53 (TP53), PBF, PRAME, PSMA, RAGE-I, RNF43, RU2AS, SOX1O, STEAP1, survivin (BIRC5), human telomerase reverse transcriptase (hTERT), telomerase, Wilms' tumor gene (WT1), SYCP1, BRDT, SPANX, XAGE, ADAM2, PAGE-5, LIP1, CTAGE-I, CSAGE, MMA1, CAGE, BORIS, HOM-TES-85, AF15q14, HCA661, LDHC, MORC, SGY-I, SPO11, TPX1, NY-SAR-35, FTHL17, NXF2, TDRD1, TEX15, FATE, TPTE, immunoglobulin idiotypes, Bence-Jones protein, estrogen receptors (ER), androgen receptors (AR), CD40, CD30, CD20, CD19, CD33, cancer antigen 72-4 (CA 72-4), cancer antigen 15-3 (CA 15-3), cancer antigen 27-29 (CA 27-29), cancer antigen 125 (CA 125), cancer antigen 19-9 (CA 19-9), β-human chorionic gonadotropin, β-2 microglobulin, squamous cell carcinoma antigen, neuron-specific enolase, heat shock protein gp96, GM2, sargramostim, CTLA-4, 707 alanine proline (707-AP), adenocarcinoma antigen recognized by T cells 4 (ART-4), carcinoembryogenic antigen peptide-1 (CAP-I), calcium-activated chloride channel-2 (CLCA2), cyclophilin B (Cyp-B), human signet ring tumor-2 (HST-2), Human papilloma virus (HPV) proteins (HPV-E6, HPV-E7, major or minor capsid antigens, others), Epstein-Barr virus (EBV) proteins (EBV latent membrane proteins—LMP1, LMP2; others), Hepatitis B or C virus proteins, and HIV proteins.

In some embodiments, a targeting agent is specific for or binds to a component, which includes, but is not limited to, HER1/EGFR, HER2/ERBB2, CD20, CD25 (IL-2Rα receptor), CD33, CD52, CD133, CD206, CEA, CEACAM1, CEACAM3, CEACAM5, CEACAM6, cancer antigen 125 (CA125), alpha-fetoprotein (AFP), Lewis Y, TAG72, Caprin-1, mesothelin, PDGF receptor (PDGFR; such as PDGF-R α), PD-1, PD-L1, CTLA-4, IL-2 receptor, vascular endothelial growth factor (VEGF), CD30, EpCAM, EphA2, Glypican-3, gpA33, mucins, CAIX, PSMA, folate-binding protein, gangliosides (such as GD2, GD3, GM1 and GM2), VEGF receptor (VEGFR), VEGFR2, VEGF-A, integrin αVβ3, integrin α5β1, ERBB3, MET, IGF1R, EPHA3, TRAILR1, TRAILR2, RANKL, FAP, tenascin, AFP, BCR complex, CD3, CD18, CD44, CTLA-4, gp72, HLA-DR 10 β, HLA-DR antigen, IgE, MUC-1, nuC242, PEM antigen, metalloproteinases, Ephrin receptor, Ephrin ligands, HGF receptor, CXCR4, CXCR4, Bombesin receptor, SK-1antigen, Bcr-ab1, RET, MET, TRKB, TIE2, ALK, ROS, EML4-ALK, ROS1, BRAFV600E, SRC, c-KIT, mTOR, TSC1, TSC2, BTK, KIT, BRCA, CDK 4/6, JAK1, JAK2, BRAF, FLT-3, MEK1, MEK2, SMO or B7-H6 (NCR3LG1).

In some embodiments, an IgSF conjugate, through its targeting agent, will bind a cellular component of a tumor cell, tumor vasculature or tumor microenvironment, thereby promoting killing of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells). Moreover, in some instances one or more of the foregoing pathways may operate upon administration of one or more IgSF conjugates of the invention.

In some embodiments, an IgSF conjugate, through its targeting agent, will be localized to, such as bind to, a cellular component of a tumor cell, tumor vasculature or tumor microenvironment, thereby modulating cells of the immune response in the vicinity of the tumor. In some embodiments, the targeting agent facilitates delivery of the conjugated IgSF (e.g. vIgD) to the tumor target, such as to interact with its cognate binding partner to alter signaling of immune cells (e.g. NK cells, monocytes/macrophages, dendritic cells, T cells, B cells) bearing the cognate binding partner. In some embodiments, localized delivery agonizes or stimulates the costimulatory receptor.

In some embodiments, the targeting agent is an immunoglobulin. As used herein, the term "immunoglobulin" includes natural or artificial mono- or polyvalent antibodies including, but not limited to, polyclonal, monoclonal, multispecific, human, humanized or chimeric antibodies, single chain antibodies, Fab fragments, F(ab') fragments, fragments produced by a Fab expression library, single chain Fv (scFv); anti-idiotypic (anti-Id) antibodies (including, e.g., anti-Id antibodies to antibodies of the invention), and epitope-binding fragments of any of the above. The term "antibody," as used herein, refers to immunoglobulin molecules and immunologically active portions of immunoglobulin molecules, e.g., molecules that contain an antigen binding site that immunospecifically binds an antigen. The immunoglobulin molecules of the invention can be of any type (e.g., IgG, IgE, IgM, IgD, IgA, and IgY), class (e.g., IgG1, IgG2, IgG3, IgG4, IgA1, and IgA2) or subclass of immunoglobulin molecule.

In some embodiments, an IgSF conjugate, through its antibody targeting moiety, will bind a cellular component of a tumor cell, tumor vasculature or tumor microenvironment, thereby promoting apoptosis of targeted cells via modulation of the immune response, (e.g., by activation of co-stimulatory molecules or inhibition of negative regulatory molecules of immune cell activation), inhibition of survival signals (e.g., growth factor or cytokine or hormone receptor antagonists), activation of death signals, and/or immune-mediated cytotoxicity, such as through antibody dependent cellular cytotoxicity. Such IgSF conjugates can function through several mechanisms to prevent, reduce or eliminate tumor cells, such as to facilitate delivery of conjugated effector moieties to the tumor target, such as through receptor-mediated endocytosis of the IgSF conjugate; or such conjugates can recruit, bind, and/or activate immune cells (e.g. NK cells, monocytes/macrophages, dendritic cells, T cells, B cells).

In some embodiments, an IgSF conjugate, through its antibody targeting moiety, will bind a cellular component of a tumor cell, tumor vasculature or tumor microenvironment, thereby modulating the immune response (e.g., by activation of co-stimulatory molecules or inhibition of negative regulatory molecules of immune cell activation). In some embodiments, such conjugates can recognize, bind, and/or modulate (e.g. inhibit or activate) immune cells (e.g. NK cells, monocytes/macrophages, dendritic cells, T cells, B cells).

Antibody targeting moieties of the invention include antibody fragments that include, but are not limited to, Fab, Fab' and F(ab')2, Fd, single-chain Fvs (scFv), single-chain antibodies, disulfide-linked Fvs (sdFv) and fragments comprising either a VL or VH domain. Antigen-binding antibody fragments, including single-chain antibodies, may comprise the variable region(s) alone or in combination with the entirety or a portion of the following: hinge region, CH1, CH2, and CH3 domains. Also included in the invention are antigen-binding fragments also comprising any combination of variable region(s) with a hinge region, CH1, CH2, and CH3 domains. Also included in the invention are Fc fragments, antigen-Fc fusion proteins, and Fc-targeting moiety conjugates or fusion products (Fc-peptide, Fc-aptamer). The antibody targeting moieties of the invention may be from any animal origin including birds and mammals. In one aspect, the antibody targeting moieties are human, murine (e.g., mouse and rat), donkey, sheep, rabbit, goat, guinea pig, camel, horse, or chicken. Further, such antibodies may be humanized versions of animal antibodies. The antibody targeting moieties of the invention may be monospecific, bispecific, trispecific, or of greater multispecificity.

In various embodiments, an antibody/targeting moiety recruits, binds, and/or activates immune cells (e.g. NK cells, monocytes/macrophages, dendritic cells) via interactions between Fc (in antibodies) and Fc receptors (on immune cells) and via the conjugated variant polypeptides or immunomodulatory proteins provided herein. In some embodiments, an antibody/targeting moiety recognizes or binds a tumor agent via and localizes to the tumor cell the conjugated variant polypeptides or immunomodulatory proteins provided herein to facilitate modulation of immune cells in the vicinity of the tumor.

Examples of antibodies which can be incorporated into IgSF conjugates include but are not limited to antibodies such as Cetuximab (IMC-C225; Erbitux®), Trastuzumab (Herceptin®), Rituximab (Rituxan®; MabThera®), Bevacizumab (Avastin®), Alemtuzumab (Campath®; Campath-1H®; Mabcampath®), Pertuzumab (Perjeta®), Panitumumab (ABX-EGF; Vectibix®), Ranibizumab (Lucentis®), Ibritumomab, Ibritumomab tiuxetan, (Zevalin®), Tositumomab, Iodine I 131 Tositumomab (BEXXAR®), Catumaxomab (Removab®), Dinutuximab (Unituxin™), Gemtuzumab, Gemtuzumab ozogamicine (Mylotarg®), Abatacept (CTLA4-Ig; Orencia®), Belatacept (L104EA29YIg; LEA29Y; LEA), Ipilimumab (MDX-010; MDX-101), Tremelimumab (ticilimumab; CP-675,206), PRS-010, PRS-050, Aflibercept (VEGF Trap, AVE005), Volociximab (M200), F200, MORAb-009, SS1P (CAT-5001), Cixutumumab (IMC-A12), Matuzumab (EMD72000), Nimotuzumab (h-R3), Zalutumumab (HuMax-EGFR), Necitumumab IMC-11F8, mAb806/ch806, Sym004, mAb-425, Panorex @ (17-1A) (murine monoclonal antibody); Panorex @ (17-1A) (chimeric murine monoclonal antibody); IDEC-Y2B8 (murine, anti-CD2O MAb); BEC2 (anti-idiotypic MAb, mimics the GD epitope) (with BCG); Olaratumab (Lartruvo™); Oncolym (Lym-1 monoclonal antibody); SMART MI95 Ab, humanized 13' I LYM-I (Oncolym), Ovarex (B43.13, anti-idiotypic mouse MAb); Ramucirumab (Cyramza®); MDX-210 (humanized anti-HER-2 bispecific antibody); 3622W94 MAb that binds to EGP40 (17-1A) pancarcinoma antigen on adenocarcinomas; Anti-VEGF, Zenapax (SMART Anti-Tac (IL-2 receptor); SMART M195 Ab, humanized Ab, humanized); MDX-210 (humanized anti-HER-2 bispecific antibody); MDX-447 (humanized anti-EGF receptor bispecific antibody); NovoMAb-G2 (pancarcinoma specific Ab); TNT (chimeric MAb to histone antigens); TNT (chimeric MAb to histone antigens); Gliomab-H (Monoclon s-Humanized Abs); GNI-250 Mab; EMD-72000 (chimeric-EGF antagonist); LymphoCide (humanized LL2 antibody); and MDX-260 bispecific, targets GD-2, ANA Ab, SMART ID1O Ab, SMART ABL 364 Ab or ImmuRAIT-CEA. As illustrated by the forgoing list, it is conventional to make antibodies to a particular target epitope.

In some embodiments, the antibody or antigen-binding fragment of the provided conjugates, including fusion molecules, is cetuximab, panitumumab, zalutumumab, nimotuzumab, trastuzumab, Ado-trastuzumab emtansine, Tositumomab (Bexxar®), Rituximab (Rituxan, Mabthera), Ibritumomab tiuxetan (Zevalin), Daclizumab (Zenapax), Gemtuzumab (Mylotarg), Alemtuzumab, CEA-scan Fab fragment, OC125 monoclonal antibody, ab75705, B72.3, Bevacizumab (Avastin®), Afatinib, Axitinib, Bosutinib, Cabozantinib, Ceritinib, Crizotinib, Dabrafenib, Dasatinib, Dinutuximab (Unituxin™), Erlotinib, Everolimus, Ibrutinib, Imatinib, Lapatinib, Lenvatinib, Nilotinib, Olaparib, Olaratumab (Lartruvo™), Palbociclib, Pazopanib, Pertuzumab (Perjeta®), Ramucirumab (Cyramza®), Regorafenib, Ruxolitinib, Sorafenib, Sunitinib, Temsirolimus, Trametinib, Vandetanib, Vemurafenib, Vismodegib, Basiliximab, Ipilimumab, Nivolumab, pembrolizumab, MPDL3280A, Pidilizumab (CT-011), AMP-224, MSB001078C, or MEDI4736, BMS-935559, LY3300054, atezolizumab, avelumab or durvalumab or is an antigen-binding fragment thereof.

In some embodiments, PD-L1 antibodies or antigen binding fragments thereof can be incorporated into the IgSF conjugates. Examples of PD-L1 antibodies which can be incorporated into IgSF conjugates include but are not limited to antibodies such as BMS-936559, 12A4, LY3300054, Atezolizumab (Tecentriq®), Avelumab (Bavencio®), Durvalumab (Imfinzi®). See, e.g., WO2007/005874, WO2017/034916, WO2010/077634, WO2013/079174, WO2011/066389, these references are incorporated by reference in their entirety. In some embodiments, the vIgD is linked, directly or indirectly, to the N- or C-terminus of the light and/or heavy chain of an anti-PD-L1 antibody. In some embodiments, the anti-PD-L1 antibody is BMS-936559, LY3300054, atezolizumab, avelumab or durvalumab. Exemplary light chain and heavy chain of an anti-PD-L1 antibody atezolizumab are set forth in SEQ ID NO: 866 and 867, respectively. Exemplary IgSF conjugates that include the anti-PD-L1 antibody Atezolizumab is set forth in SEQ ID NOs: 868-895.

In some embodiments, the antibody targeting moiety is a full length antibody, or antigen-binding fragment thereof, containing an Fc domain. In some embodiments, the variant polypeptide or immunomodulatory protein is conjugated to the Fc portion of the antibody targeting moiety, such as by conjugation to the N-terminus of the Fc portion of the antibody.

Figure 10A:
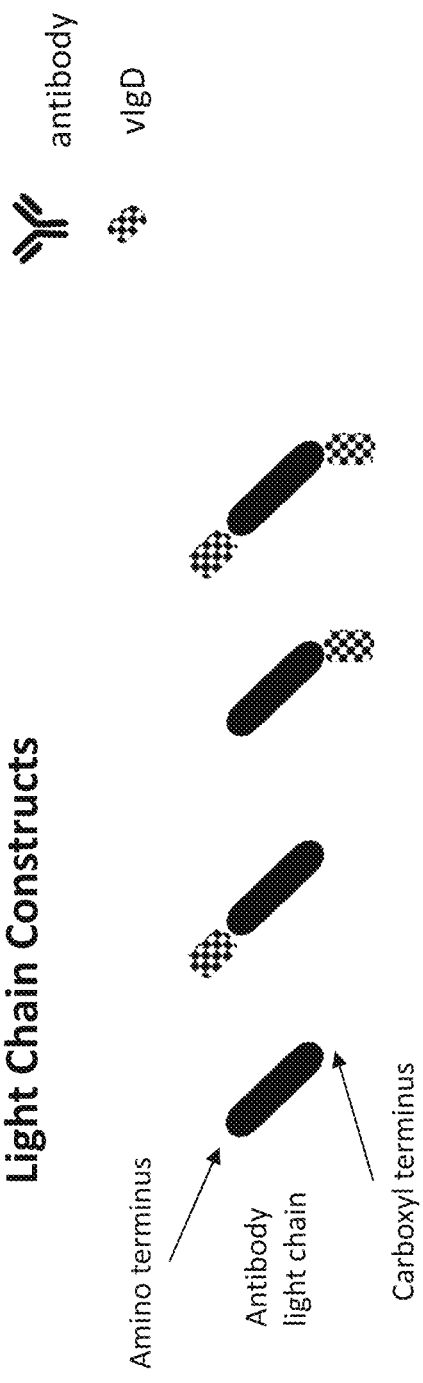
FIGS. 10A-10C depicts various exemplary configurations of a variant IgSF domain (vIgD) conjugated to an antibody (V-Mab).
Figure 10B:
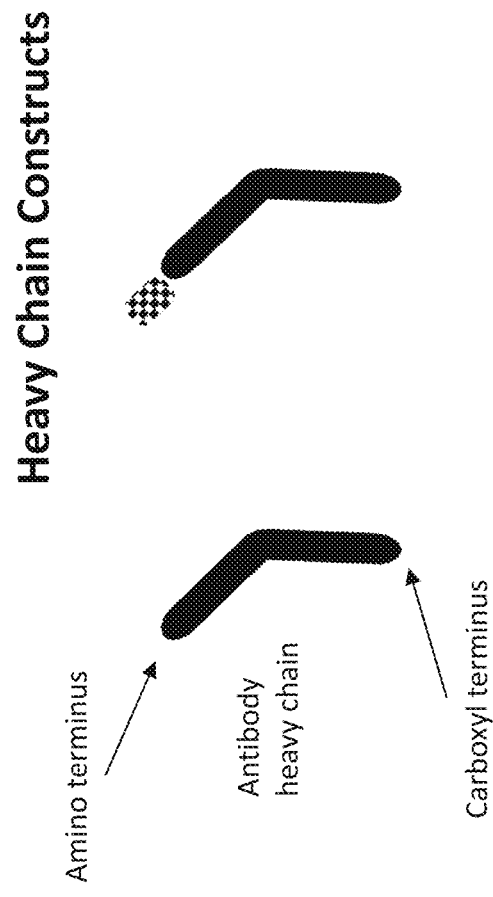
Figure 10C:
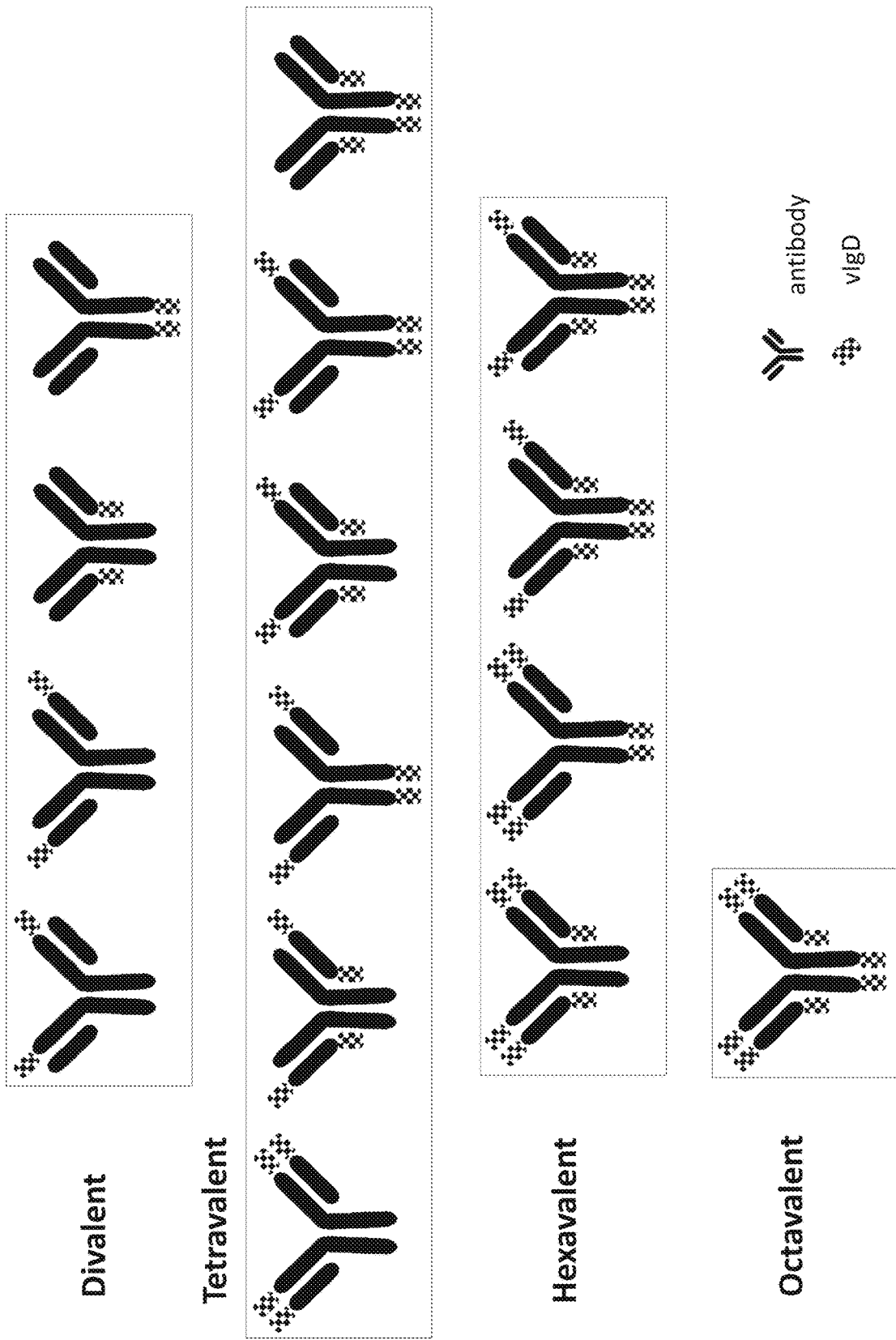

In some embodiments, the vIgD is linked, directly or indirectly, to the N- or C-terminus of the light and/or heavy chain of the antibody. In some embodiments, linkage can be via a peptide linker, such as any described above. In some embodiments, the linker can further include amino acids introduced by cloning and/or from a restriction site. In some embodiments, the linker may include additional amino acids on either end introduced by a restriction site. For example, the linker can include additional amino acids such as SA (in one-letter amino acid code) as introduced by use of the restriction site AFEI. Various configurations can be constructed. FIGS. 10A-10C depict exemplary configurations.

In some embodiments, the antibody conjugate can be produced by co-expression of the heavy and light chain of the antibody in a cell.

In one aspect of the invention, the targeting agent is an aptamer molecule. For example, in some embodiments, the aptamer is comprised of nucleic acids that function as a targeting agent. In various embodiments, an IgSF conjugate of the invention comprises an aptamer that is specific for a molecule on a tumor cell, tumor vasculature, and/or a tumor microenvironment. In some embodiments, the aptamer itself can comprise a biologically active sequence, in addition to the targeting module (sequence), wherein the biologically active sequence can induce an immune response to the target cell. In other words, such an aptamer molecule is a dual use agent. In some embodiments, an IgSF conjugate of the invention comprises conjugation of an aptamer to an antibody, wherein the aptamer and the antibody are specific for binding to separate molecules on a tumor cell, tumor vasculature, tumor microenvironment, and/or immune cells.

The term "aptamer" includes DNA, RNA or peptides that are selected based on specific binding properties to a particular molecule. For example, an aptamer(s) can be selected for binding a particular gene or gene product in a tumor cell, tumor vasculature, tumor microenvironment, and/or an immune cell, as disclosed herein, where selection is made by methods known in the art and familiar to one of skill in the art.

In some aspects of the invention the targeting agent is a peptide. For example, the variant polypeptides or immunomodulatory proteins provided herein can be conjugated to a peptide which can bind with a component of a cancer or tumor cells. Therefore, such IgSF conjugates of the invention comprise peptide targeting agents which binds to a cellular component of a tumor cell, tumor vasculature, and/or a component of a tumor microenvironment. In some embodiments, targeting agent peptides can be an antagonist or agonist of an integrin. Integrins, which comprise an alpha and a beta subunit, include numerous types well known to a skilled artisan.

In one embodiment, the targeting agent is Vvβ3. Integrin Vvβ3 is expressed on a variety of cells and has been shown to mediate several biologically relevant processes, including adhesion of osteoclasts to bone matrix, migration of vascular smooth muscle cells, and angiogenesis. Suitable targeting molecules for integrins include RGD peptides or peptidomimetics as well as non-RGD peptides or peptidomimetics (see, e.g., U.S. Pat. Nos. 5,767,071 and 5,780,426) for other integrins such as V4.βi (VLA-4), V4-P7 (see, e.g., U.S. Pat. No. 6,365,619; Chang et al, Bioorganic & Medicinal Chem Lett, 12:159-163 (2002); Lin et al., Bioorganic & Medicinal Chem Lett, 12:133-136 (2002)), and the like.

In some embodiments, there is provided an IgSF conjugate comprising a variant polypeptide or immunomodulatory protein provided herein conjugated with a therapeutic agent. In some embodiments, the therapeutic agent includes, for example, daunomycin, doxorubicin, methotrexate, and vindesine (Rowland et al., Cancer Immunol. Immunother. 21:183-187, 1986). In some embodiments, the therapeutic agent has an intracellular activity. In some embodiments, the IgSF conjugate is internalized and the therapeutic agent is a cytotoxin that blocks the protein synthesis of the cell, therein leading to cell death. In some embodiments, the therapeutic agent is a cytotoxin comprising a polypeptide having ribosome-inactivating activity including, for example, gelonin, bouganin, saporin, ricin, ricin A chain, bryodin, diphtheria toxin, restrictocin, Pseudomonas exotoxin A and variants thereof. In some embodiments, where the therapeutic agent is a cytotoxin comprising a polypeptide having a ribosome-inactivating activity, the IgSF conjugate must be internalized upon binding to the target cell in order for the protein to be cytotoxic to the cells.

In some embodiments, there is provided an IgSF conjugate comprising a variant polypeptide or immunomodulatory protein provided herein conjugated with a toxin. In some embodiments, the toxin includes, for example, bacterial toxins such as diphtheria toxin, plant toxins such as ricin, small molecule toxins such as geldanamycin (Mandler et al., J. Nat. Cancer Inst. 92(19):1573-1581 (2000); Mandler et al., Bioorganic & Med. Chem. Letters 10:1025-1028 (2000); Mandler et al., Bioconjugate Chem. 13:786-791 (2002)), maytansinoids (EP 1391213; Liu et al., Proc. Natl. Acad. Sci. USA 93:8618-8623 (1996)), and calicheamicin (Lode et al., Cancer Res. 58:2928 (1998); Hinman et al., Cancer Res. 53:3336-3342 (1993)). The toxins may exert their cytotoxic and cytostatic effects by mechanisms including tubulin binding, DNA binding, or topoisomerase inhibition.

In some embodiments, there is provided an IgSF conjugate comprising a variant polypeptide or immunomodulatory protein provided herein conjugated with a label, which can generate a detectable signal, indirectly or directly. These IgSF conjugates can be used for research or diagnostic applications, such as for the in vivo detection of cancer. The label is preferably capable of producing, either directly or indirectly, a detectable signal. For example, the label may be radio-opaque or a radioisotope, such as 3H, 14C, 32P, 35S, 123I, 125I, 131I; a fluorescent (fluorophore) or chemiluminescent (chromophore) compound, such as fluorescein isothiocyanate, rhodamine or luciferin; an enzyme, such as alkaline phosphatase,β-galactosidase or horseradish peroxidase; an imaging agent; or a metal ion. In some embodiments, the label is a radioactive atom for scintigraphic studies, for example 99Tc or 123I, or a spin label for nuclear magnetic resonance (NMR) imaging (also known as magnetic resonance imaging, MRI), such as zirconium-89, iodine-123, iodine-131, indium-111, fluorine-19, carbon-13, nitrogen-15, oxygen-17, gadolinium, manganese or iron. Zirconium-89 may be complexed to various metal chelating agents and conjugated to antibodies, e.g., for PET imaging (WO 2011/056983). In some embodiments, the IgSF conjugate is detectable indirectly. For example, a secondary antibody that is specific for the IgSF conjugate and contains a detectable label can be used to detect the IgSF conjugate.

The IgSF conjugates may be prepared using any methods known in the art. See, e.g., WO 2009/067800, WO 2011/133886, and U.S. Patent Application Publication No. 2014322129, incorporated by reference herein in their entirety.

The variant polypeptides or immunomodulatory proteins of an IgSF conjugate may be "attached to" the effector moiety by any means by which the variant polypeptides or immunomodulatory proteins can be associated with, or linked to, the effector moiety. For example, the variant polypeptides or immunomodulatory proteins of an IgSF conjugate may be attached to the effector moiety by chemical or recombinant means. Chemical means for preparing fusions or conjugates are known in the art and can be used to prepare the IgSF conjugate. The method used to conjugate the variant polypeptides or immunomodulatory proteins and effector moiety must be capable of joining the variant polypeptides or immunomodulatory proteins with the effector moiety without interfering with the ability of the variant polypeptides or immunomodulatory proteins to bind to their one or more counter structure ligands.

The variant polypeptides or immunomodulatory proteins of an IgSF conjugate may be linked indirectly to the effector moiety. For example, the variant polypeptides or immunomodulatory proteins of an IgSF conjugate may be directly linked to a liposome containing the effector moiety of one of several types. The effector moiety(s) and/or the variant polypeptides or immunomodulatory proteins may also be bound to a solid surface.

In some embodiments, the variant polypeptides or immunomodulatory proteins of an IgSF conjugate and the effector moiety are both proteins and can be conjugated using techniques well known in the art. There are several hundred crosslinkers available that can conjugate two proteins. (See for example "Chemistry of Protein Conjugation and Cross-linking," 1991, Shans Wong, CRC Press, Ann Arbor). The crosslinker is generally chosen based on the reactive functional groups available or inserted on the variant polypeptides or immunomodulatory proteins and/or effector moiety. In addition, if there are no reactive groups, a photoactivatable crosslinker can be used. In certain instances, it may be desirable to include a spacer between the variant polypeptides or immunomodulatory proteins and the effector moiety. Crosslinking agents known to the art include the homobifunctional agents: glutaraldehyde, dimethyladipimidate and Bis(diazobenzidine) and the heterobifunctional agents: m Maleimidobenzoyl-N-Hydroxysuccinimide and Sulfo-m Maleimidobenzoyl-N-Hydroxysuccinimide.

In some embodiments, the variant polypeptides or immunomodulatory proteins of an IgSF conjugate may be engineered with specific residues for chemical attachment of the effector moiety. Specific residues used for chemical attachment of molecule known to the art include lysine and cysteine. The crosslinker is chosen based on the reactive functional groups inserted on the variant polypeptides or immunomodulatory proteins, and available on the effector moiety.

An IgSF conjugate may also be prepared using recombinant DNA techniques. In such a case a DNA sequence encoding the variant polypeptides or immunomodulatory proteins is fused to a DNA sequence encoding the effector moiety, resulting in a chimeric DNA molecule. The chimeric DNA sequence is transfected into a host cell that expresses the fusion protein. The fusion protein can be recovered from the cell culture and purified using techniques known in the art.

Examples of attaching an effector moiety, which is a label, to the variant polypeptides or immunomodulatory proteins include the methods described in Hunter, et al., Nature 144:945 (1962); David, et al., Biochemistry 13:1014 (1974); Pain, et al., J. Immunol. Meth. 40:219 (1981); Nygren, J. Histochem. and Cytochem. 30:407 (1982); Wensel and Meares, Radioimmunoimaging and Radioimmunotherapy, Elsevier, N.Y. (1983); and Colcher et al., "Use Of Monoclonal Antibodies as Radiopharmaceuticals For The Localization Of Human Carcinoma Xenografts In Athymic Mice", Meth. Enzymol., 121:802-16 (1986).

The radio- or other labels may be incorporated in the conjugate in known ways. For example, the peptide may be biosynthesized or may be synthesized by chemical amino acid synthesis using suitable amino acid precursors involving, for example, fluorine-19 in place of hydrogen. Labels such as 99Tc or 123I, 186Re, 188Re and 111In can be attached via a cysteine residue in the peptide. Yttrium-90 can be attached via a lysine residue. The IODOGEN method (Fraker et al., Biochem. Biophys. Res. Commun. 80:49-57 (1978)) can be used to incorporate iodine-123. "Monoclonal Antibodies in Immunoscintigraphy" (Chatal, CRC Press 1989) describes other methods in detail.

Conjugates of the variant polypeptides or immunomodulatory proteins and a cytotoxic agent may be made using a variety of bifunctional protein coupling agents such as N-succinimidyl-3-(2-pyridyldithio) propionate (SPDP), succinimidyl-4-(N-maleimidomethyl) cyclohexane-1-carboxylate (SMCC), iminothiolane (IT), bifunctional derivatives of imidoesters (such as dimethyl adipimidate HCl), active esters (such as disuccinimidyl suberate), aldehydes (such as glutaraldehyde), bis-azido compounds (such as bis (p-azidobenzoyl) hexanediamine), bis-diazonium derivatives (such as bis-(p-diazoniumbenzoyl)-ethylenediamine), diisocyanates (such as toluene 2,6-diisocyanate), and bis-active fluorine compounds (such as 1,5-difluoro-2,4-dinitrobenzene). For example, a ricin immunotoxin can be prepared as described in Vitetta et al., Science 238:1098 (1987). Carbon-14-labeled 1-p-isothiocyanatobenzyl-3-methyldiethylenetriaminepentaacetic acid (MX-DTPA) is an exemplary chelating agent for conjugation of radionucleotide to the antibody. See, e.g., WO94/11026. The linker may be a "cleavable linker" facilitating release of the cytotoxic drug in the cell. For example, an acid-labile linker, peptidase-sensitive linker, photolabile linker, dimethyl linker or disulfide-containing linker (Chari et al., Cancer Research 52:127-131 (1992); U.S. Pat. No. 5,208,020) may be used.

The IgSF conjugates of the invention expressly contemplate, but are not limited to, drug conjugates prepared with cross-linker reagents: BMPS, EMCS, GMBS, HBVS, LC-SMCC, MBS, MPBH, SBAP, SIA, SIAB, SMCC, SMPB, SMPH, sulfo-EMCS, sulfo-GMBS, sulfo-KMUS, sulfo-MBS, sulfo-SIAB, sulfo-SMCC, and sulfo-SMPB, and SVSB (succinimidyl-(4-vinylsulfone)benzoate) which are commercially available (e.g., from Pierce Biotechnology, Inc., Rockford, Ill., U.S.A). See pages 467-498, 2003-2004 Applications Handbook and Catalog.

C. Transmembrane and Secretable Immunomodulatory Proteins and Engineered Cells

Provided herein are engineered cells which express the immunomodulatory variant ICOSL polypeptides (alternatively, "engineered cells"). In some embodiments, the variant ICOSL polypeptide is expressed on a cell, such as an immune cell (e.g. T cell or antigen presenting cell), in membrane-bound form, thereby providing a transmembrane immunomodulatory protein (hereinafter also called a "TIP"). In some aspects, the variant ICOSL polypeptide is expressed in a cell, such as an immune cell (e.g. T cell or antigen presenting cell), in secretable form to thereby produce a secreted or soluble form of the variant ICOSL polypeptide (hereinafter also called a "SIP"), such as when the cells are administered to a subject. In some aspects, a SIP can antagonize a cognate binding partner in the environment (e.g. tumor microenvironment) in which it is secreted.

1. Transmembrane Immunomodulatory Proteins

In some embodiments, an immunomodulatory polypeptide comprising a variant ICOSL can be a membrane bound protein. As described in more detail below, the immunomodulatory polypeptide can be a transmembrane immunomodulatory polypeptide comprising a variant ICOSL in which is contained: an ectodomain containing at least one affinity modified IgSF domain (IgV or IgC), a transmembrane domain and, optionally, a cytoplasmic domain. In some embodiments, the transmembrane immunomodulatory protein can be expressed on the surface of an immune cell, such as a mammalian cell, including on the surface of a lymphocyte (e.g. T cell or NK cell) or antigen presenting cell. In some embodiments, the transmembrane immunomodulatory protein is expressed on the surface of a mammalian T-cell, including such T-cells as: a T helper cell, a cytotoxic T-cell (alternatively, cytotoxic T lymphocyte or CTL), a natural killer T-cell, a regulatory T-cell, a memory T-cell, or a gamma delta T-cell. In some embodiments, the mammalian cell is an antigen presenting cell (APC). Typically, but not exclusively, the ectodomain (alternatively, "extracellular domain") of comprises the one or more amino acid variations (e.g. amino acid substitutions) of the variant ICOSL of the invention. Thus, for example, in some embodiments a transmembrane protein will comprise an ectodomain that comprises one or more amino acid substitutions of a variant ICOSL of the invention.

In some embodiments, the engineered cells express variant ICOSL polypeptides that are transmembrane immunomodulatory polypeptides (TIPs) that can be a membrane protein such as a transmembrane protein. In typical embodiments, the ectodomain of a membrane protein comprises an extracellular domain or IgSF domain thereof of a variant ICOSL provided herein in which is contained one or more amino acid substitutions in at least one IgSF domain as described. The transmembrane immunomodulatory proteins provided herein further contain a transmembrane domain linked to the ectodomain. In some embodiments, the transmembrane domain results in an encoded protein for cell surface expression on a cell. In some embodiments, the transmembrane domain is linked directly to the ectodomain. In some embodiments, the transmembrane domain is linked indirectly to the ectodomain via one or more linkers or spacers. In some embodiments, the transmembrane domain contains predominantly hydrophobic amino acid residues, such as leucine and valine.

In some embodiments, a full length transmembrane anchor domain can be used to ensure that the TIPs will be expressed on the surface of the engineered cell, such as engineered T cell. Conveniently, this could be from a particular native protein that is being affinity modified (e.g. ICOSL or other native IgSF protein), and simply fused to the sequence of the first membrane proximal domain in a similar fashion as the native IgSF protein (e.g. ICOSL). In some embodiments, the transmembrane immunomodulatory protein comprises a transmembrane domain of the corresponding reference (e.g., unmodified) or wild-type IgSF member, such as a transmembrane domain contained in the sequence of amino acids set forth in SEQ ID NO:5 (Table 2). In some embodiments, the membrane bound form comprises a transmembrane domain of the corresponding reference (e.g., unmodified) or wild-type polypeptide, such as corresponding to residues 257-277 of SEQ ID NO:5.

In some embodiments, the transmembrane domain is a non-native transmembrane domain that is not the transmembrane domain of native ICOSL. In some embodiments, the transmembrane domain is derived from a transmembrane domain from another non-ICOSL family member polypeptide that is a membrane-bound or is a transmembrane protein. In some embodiments, a transmembrane anchor domain from another protein on T cells can be used. In some embodiments, the transmembrane domain is derived from CD8. In some embodiments, the transmembrane domain can further contain an extracellular portion of CD8 that serves as a spacer domain. An exemplary CD8 derived transmembrane domain is set forth in SEQ ID NO: 246 or 483 or a portion thereof containing the CD8 transmembrane domain. In some embodiments, the transmembrane domain is a synthetic transmembrane domain.

In some embodiments, the transmembrane immunomodulatory protein further contains an endodomain, such as a cytoplasmic signaling domain, linked to the transmembrane domain. In some embodiments, the cytoplasmic signaling domain induces cell signaling. In some embodiments, the endodomain of the transmembrane immunomodulatory protein comprises the cytoplasmic domain of the corresponding reference (e.g., unmodified) or wild-type polypeptide, such as a cytoplasmic domain contained in the sequence of amino acids set forth in SEQ ID NO:5 (see Table 2).

In some embodiments, a provided transmembrane immunomodulatory protein that is or comprises a variant ICOSL comprises a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 257 and contains an ectodomain comprising at least one affinity-modified ICOSL IgSF domain as described and a transmembrane domain. In some embodiments, the transmembrane immunomodulatory protein contains any one or more amino acid substitutions in an IgSF domain (e.g. IgV domain) as described, including any set forth in Table 1. In some embodiments, the transmembrane immunomodulatory protein can further comprise a cytoplasmic domain as described. In some embodiments, the transmembrane immunomodulatory protein can further contain a signal peptide. In some embodiments, the signal peptide is the native signal peptide of wild-type IgSF member, such as contained in the sequence of amino acids set forth in SEQ ID NO: 5 (see e.g. Table 2).

In some embodiments, provided are transmembrane immunomodulatory proteins comprising the amino acid substitutions E16V/N52H/N57Y/Q100R/V110D/H115R/Y152C/K156M/C198R, N52H/N57Y/Q100R, or N52H/N57Y/Q100P. In some embodiments, the provided transmembrane immunomodulatory protein is or comprises a variant ICOSL comprising the sequence of amino acids set forth in SEQ ID NO:257, but in which is contained amino substitutions E16V/N52H/N57Y/Q100R/V110D/H115R/Y152C/K156M/C198R, N52H/N57Y/Q100R, or N52H/N57Y/Q100P at corresponding positions in SEQ ID NO:257, or a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 257 and contains the amino acid substitutions E16V/N52H/N57Y/Q100R/V110D/H115R/Y152C/K156M/C198R, N52H/N57Y/Q100R, or N52H/N57Y/Q100P.

In some embodiments, provided are transmembrane immunomodulatory proteins comprising the sequence of amino acids set forth in SEQ ID NOS: 496 or 497 (each containing the amino acid substitution N52D), SEQ ID NOS: 498 or 499 (each containing the amino acid substitutions N52H/N57Y/Q100P), SEQ ID NOS: 500 or 501 (each containing the amino acid substitutions E16V/N52H/N57Y/Q100R/V110D/H115R/Y152C/K156M/C198R) or SEQ ID NOS: 502 or 503 (each containing the amino acid substitutions N52H/N57Y/Q100R), or a sequence of amino acids that comprises at least 85%, 86%, 87%, 88%, 89%, 90%, 91%, 92%, 93%, 94%, 95%, 96%, 97%, 98% or 99% sequence identity to any of SEQ ID NOS: 495-503 and that contains the indicated amino acid substitutions. In some embodiments, when expressed in an engineered cell, such transmembrane immunomodulatory proteins are expressed on the surface of the cell.

Also provided is a nucleic acid molecule encoding such transmembrane immunomodulatory proteins. In some embodiments, a nucleic acid molecule encoding a transmembrane immunomodulatory protein comprises a nucleotide sequence that encodes a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 257 and contains an ectodomain comprising at least one affinity-modified IgSF domain as described, a transmembrane domain and, optionally, a cytoplasmic domain. In some embodiments, the nucleic acid molecule can further comprise a sequence of nucleotides encoding a signal peptide. In some embodiments, the signal peptide is the native signal peptide of the corresponding wild-type IgSF member (see e.g. Table 2).

Exemplary of a transmembrane immunomodulatory protein is a ICOSL TIP comprising i) the sequence of amino acids set forth in SEQ ID NO:383 or ii) a sequence of amino acids that exhibits at least 85%, 86%, 87%, 88%, 89%, 90%, 91%, 92%, 93%, 94%, 95%, 96%, 97%, 98% or 99% sequence identity to SEQ ID NO: 243 and that comprises the affinity-modified domain contained in SEQ ID NO: 243 or the amino acid substitutions therein. Also provided is i) a sequence of nucleotides set forth in SEQ ID NO: 244, ii) a sequence that exhibits at least 85%, 86%, 87%, 88%, 89%, 90%, 91%, 92%, 93%, 94%, 95%, 96%, 97%, 98% or 99% sequence identity to SEQ ID NO: 244 and that encodes a TIP that comprises the affinity-modified domain of SEQ ID NO: 243, or iii) a sequence of i) or ii) having degenerate codons.

In some embodiments, provided are CAR-related transmembrane immunomodulatory proteins in which the endodomain of a transmembrane immunomodulatory protein comprises a cytoplasmic signaling domain that comprises at least one ITAM (immunoreceptor tyrosine-based activation motif)-containing signaling domain. ITAM is a conserved motif found in a number of protein signaling domains involved in signal transduction of immune cells, including in the CD3-zeta chain ("CD3-z") involved in T-cell receptor signal transduction. In some embodiments, the endodomain comprises at CD3-zeta signaling domain. In some embodiments, the CD3-zeta signaling domain comprises the sequence of amino acids set forth in SEQ ID NO: 243 or a sequence of amino acids that exhibits at least 85%, 86%, 87%, 88%, 89%, 90%, 91%, 92%, 93%, 94%, 95%, 96%, 97%, 98% or 99% to SEQ ID NO:247 and retains the activity of T cell signaling. In some embodiments, the endodomain of a CAR-related transmembrane immunomodulatory protein can further comprise a costimulatory signaling domain to further modulate immunomodulatory responses of the T-cell. In some embodiments, the costimulatory signaling domain is CD28, ICOS, 41BB or OX40. In some embodiments, the costimulatory signaling domain is a derived from CD28 or 4-1BB and comprises the sequence of amino acids set forth in any of SEQ ID NOS: 484-487 or a sequence of amino acids that exhibits at least 85%, 86%, 87%, 88%, 89%, 90%, 91%, 92%, 93%, 94%, 95%, 96%, 97%, 98% or 99% to SEQ ID NO: 484-487 and retains the activity of T cell costimulatory signaling. In some embodiments, the provided CAR-related transmembrane immunomodulatory proteins have features of CARs to stimulate T cell signaling upon binding of an affinity modified IgSF domain to a cognate binding partner or counter structure. In some embodiments, upon specific binding by the affinity-modified IgSF domain to its counter structure can lead to changes in the immunological activity of the T-cell activity as reflected by changes in cytotoxicity, proliferation or cytokine production.

In some embodiments, the transmembrane immunomodulatory protein does not contain an endodomain capable of mediating cytoplasmic signaling. In some embodiments, the transmembrane immunomodulatory protein lacks the signal transduction mechanism of the wild-type or unmodified polypeptide and therefore does not itself induce cell signaling. In some embodiments, the transmembrane immunomodulatory protein lacks an intracellular (cytoplasmic) domain or a portion of the intracellular domain of the corresponding reference (e.g., unmodified) or wild-type polypeptide, such as a cytoplasmic signaling domain contained in the sequence of amino acids set forth in SEQ ID NO:5 (see Table 2). In some embodiments, the transmembrane immunomodulatory protein does not contain an ITIM (immunoreceptor tyrosine-based inhibition motif), such as contained in certain inhibitory receptors, including inhibitory receptors of the IgSF family (e.g. PD-1 or TIGIT). Thus, in some embodiments, the transmembrane immunomodulatory protein only contains the ectodomain and the transmembrane domain, such as any as described.

2. Secreted Immunomodulatory Proteins and Engineered Cells

In some embodiments, the ICOSL variant immunomodulatory polypeptide containing any one or more of the amino acid mutations as described herein, is secretable, such as when expressed from a cell. Such a variant ICOSL immunomodulatory protein does not comprise a transmembrane domain. In some embodiments, the variant ICOSL immunomodulatory protein is not conjugated to a half-life extending moiety (such as an Fc domain or a multimerization domain). In some embodiments, the variant ICOSL immunomodulatory protein comprises a signal peptide, e.g. an antibody signal peptide or other efficient signal sequence to get domains outside of cell. When the immunomodulatory protein comprises a signal peptide and is expressed by an engineered cell, the signal peptide causes the immunomodulatory protein to be secreted by the engineered cell. Generally, the signal peptide, or a portion of the signal peptide, is cleaved from the immunomodulatory protein with secretion. The immunomodulatory protein can be encoded by a nucleic acid (which can be part of an expression vector). In some embodiments, the immunomodulatory protein is expressed and secreted by a cell (such as an immune cell, for example a primary immune cell).

Thus, in some embodiments, there are provided variant ICOSL immunomodulatory proteins that further comprise a signal peptide. In some embodiments, provided herein is a nucleic acid molecule encoding the variant ICOSL immunomodulatory protein operably connected to a secretion sequence encoding the signal peptide.

A signal peptide is a sequence on the N-terminus of an immunomodulatory protein that signals secretion of the immunomodulatory protein from a cell. In some embodiments, the signal peptide is about 5 to about 40 amino acids in length (such as about 5 to about 7, about 7 to about 10, about 10 to about 15, about 15 to about 20, about 20 to about 25, or about 25 to about 30, about 30 to about 35, or about 35 to about 40 amino acids in length).

In some embodiments, the signal peptide is a native signal peptide from the corresponding wild-type ICOSL (see Table 6). In some embodiments, the signal peptide is a non-native signal peptide. For example, in some embodiments, the non-native signal peptide is a mutant native signal peptide from the corresponding wild-type ICOSL, and can include one or more (such as 2, 3, 4, 5, 6, 7, 8, 9, or 10 or more) substitutions insertions or deletions. In some embodiments, the non-native signal peptide is a signal peptide or mutant thereof of a family member from the same IgSF family as the wild-type IgSF family member. In some embodiments, the non-native signal peptide is a signal peptide or mutant thereof from an IgSF family member from a different IgSF family than the wild-type IgSF family member. In some embodiments, the signal peptide is a signal peptide or mutant thereof from a non-IgSF protein family, such as a signal peptide from an immunoglobulin (such as IgG heavy chain or IgG-kappa light chain), a cytokine (such as interleukin-2 (IL-2), or CD33), a serum albumin protein (e.g. HSA or albumin), a human azurocidin preprotein signal sequence, a luciferase, a trypsinogen (e.g. chymotrypsinogen or trypsinogen) or other signal peptide able to efficiently secrete a protein from a cell. Exemplary signal peptides include any described in the Table 6.

TABLE 6

Exemplary Signal Peptides

| SEQ ID NO | Signal Peptide | Peptide Sequence |
|---|---|---|
| SEQ ID NO: 346 | HSA signal peptide | MKWVTFISLLFLFSSAYS |
| SEQ ID NO: 347 | Ig kappa light chain | MDMRAPAGIFGFLLVLFPGYRS |
| SEQ ID NO: 348 | human azurocidin preprotein signal sequence | MTRLTVLALLAGLLASSRA |
| SEQ ID NO: 349 | IgG heavy chain signal peptide | MELGLSWIFLLAILKGVQC |
| SEQ ID NO: 350 | IgG heavy chain signal peptide | MELGLRWVFLVAILEGVQC |
| SEQ ID NO: 351 | IgG heavy chain signal peptide | MKHLWFFLLLVAAPRWVLS |
| SEQ ID NO: 352 | IgG heavy chain signal peptide | MDWTWRILFLVAAATGAHS |
| SEQ ID NO: 353 | IgG heavy chain signal peptide | MDWTWRFLFVVAAATGVQS |
| SEQ ID NO: 354 | IgG heavy chain signal peptide | MEFGLSWLFLVAILKGVQC |
| SEQ ID NO: 355 | IgG heavy chain signal peptide | MEFGLSWVFLVALFRGVQC |
| SEQ ID NO: 356 | IgG heavy chain signal peptide | MDLLHKNMKHLWFFLLLVAAPRWVLS |
| SEQ ID NO: 357 | IgG Kappa light chain signal sequence | MDMRVPAQLLGLLLLWLSGARC |
| SEQ ID NO: 358 | IgG Kappa light chain signal sequence | MKYLLPTAAAGLLLLAAQPAMA |
| SEQ ID NO: 359 | Gaussia luciferase | MGVKVLFALICIAVAEA |
| SEQ ID NO: 360 | Human albumin | MKWVTFISLLFLFSSAYS |
| SEQ ID NO: 361 | Human chymotrypsinogen | MAFLWLLSCWALLGTTFG |
| SEQ ID NO: 362 | Human interleukin-2 | MQLLSCIALILALV |
| SEQ ID NO: 363 | Human trypsinogen-2 | MNLLLILTFVAAAVA |

In some embodiments of a secretable variant ICOSL immunomodulatory protein, the immunomodulatory protein comprises a signal peptide when expressed, and the signal peptide (or a portion thereof) is cleaved from the immunomodulatory protein upon secretion.

In some embodiments, the engineered cells express a variant ICOSL polypeptide that is secreted from the cell. In some embodiments, such a variant ICOSL polypeptide is encoded by a nucleic acid molecule encoding an immunomodulatory protein under the operable control of a signal sequence for secretion. In some embodiments, the encoded immunomodulatory protein is secreted when expressed from a cell. In some embodiments, the immunomodulatory protein encoded by the nucleic acid molecule does not comprise a transmembrane domain. In some embodiments, the immunomodulatory protein encoded by the nucleic acid molecule does not comprise a half-life extending moiety (such as an Fc domain or a multimerization domain). In some embodiments, the immunomodulatory protein encoded by the nucleic acid molecule comprises a signal peptide. In some embodiments, a nucleic acid of the invention further comprises nucleotide sequence that encodes a secretory or signal peptide operably linked to the nucleic acid encoding the immunomodulatory protein, thereby allowing for secretion of the immunomodulatory protein 3. Cells and Engineering Cells Provided herein are engineered cells expressing any of the provided immunomodulatory polypeptides. In some embodiments, the engineered cells express on their surface any of the provided transmembrane immunomodulatory polypeptides. In some embodiments, the engineered cells express and are capable of or are able to secrete the immunomodulatory protein from the cells under conditions suitable for secretion of the protein. In some embodiments, the immunomodulatory protein is expressed on or in a lymphocyte such as a tumor infiltrating lymphocyte (TIL), T-cell or NK cell, or on a myeloid cell. In some embodiments, the engineered cells are antigen presenting cells (APCs). In some embodiments, the engineered cells are engineered mammalian T-cells or engineered mammalian antigen presenting cells (APCs). In some embodiments, the engineered T-cells or APCs are human or murine cells.

In some embodiments, engineered T-cells include, but are not limited to, T helper cell, cytotoxic T-cell (alternatively, cytotoxic T lymphocyte or CTL), natural killer T-cell, regulatory T-cell, memory T-cell, or gamma delta T-cell. In some embodiments, the engineered T cells are CD4+ or CD8+. In addition to the signal of the MHC, engineered T-cells also require a co-stimulatory signal which in some embodiments is provided by a variant ICOSL transmembrane immunomodulatory polypeptide expressed in membrane bound form as discussed previously.

In some embodiments, the engineered APCs include, for example, MHC II expressing APCs such as macrophages, B cells, and dendritic cells, as well as artificial APCs (aAPCs) including both cellular and acellular (e.g., biodegradable polymeric microparticles) aAPCs. Artificial APCs (aAPCs) are synthetic versions of APCs that can act in a similar manner to APCs in that they present antigens to T-cells as well as activate them. Antigen presentation is performed by the MHC (Class I or Class II). In some embodiments, in engineered APCs such as aAPCs, the antigen that is loaded onto the MHC is, in some embodiments, a tumor specific antigen or a tumor associated antigen. The antigen loaded onto the MHC is recognized by a T-cell receptor (TCR) of a T cell, which, in some cases, can express ICOS, CD28, or other molecule recognized by the variant ICOSL polypeptides provided herein. Materials which can be used to engineer an aAPC include: poly (glycolic acid), poly(lactic-co-glycolic acid), iron-oxide, liposomes, lipid bilayers, sepharose, and polystyrene.

In some embodiments a cellular aAPC can be engineered to contain a TIP and TCR agonist which is used in adoptive cellular therapy. In some embodiments, a cellular aAPC can be engineered to contain a TIP and TCR agonist which is used in ex vivo expansion of human T cells, such as prior to administration, e.g., for reintroduction into the patient. In some aspects, the aAPC may include expression of at least one anti-CD3 antibody clone, e.g. such as, for example, OKT3 and/or UCHT1. In some aspects, the aAPCs may be inactivated (e.g. irradiated). In some embodiment, the TIP can include any variant IgSF domain that exhibits binding affinity for a cognate binding partner on a T cell.

In some embodiments, an immunomodulatory protein provided herein, such as a transmembrane immunomodulatory protein or a secretable immunomodulatory protein, is co-expressed or engineered into a cell that expresses an antigen-binding receptor, such as a recombinant receptor, such as a chimeric antigen receptor (CAR) or T cell receptor (TCR). In some embodiments, the engineered cell, such as an engineered T cell, recognizes a desired antigen associated with cancer, inflammatory and autoimmune disorders, or a viral infection. In specific embodiments, the antigen-binding receptor contains an antigen-binding moiety that specifically binds a tumor specific antigen or a tumor associated antigen. In some embodiments, the engineered T-cell is a CAR (chimeric antigen receptor) T-cell that contains an antigen-binding domain (e.g. scFv) that specifically binds to an antigen, such as a tumor specific antigen or tumor associated antigen. In some embodiments, the antigen-binding domain (e.g. scFv) is specific for a particular antigen, e.g., CD19. Exemplary of a CAR is an anti-CD19 CAR, such as a CAR containing an anti-CD19 scFv set forth in SEQ ID NO:482 or SEQ ID NO:245. In some embodiments, the TIP protein is expressed in an engineered T-cell receptor cell or an engineered chimeric antigen receptor cell. In such embodiments, the engineered cell co-expresses the TIP and the CAR or TCR. In some embodiments, the SIP protein is expressed in an engineered T-cell receptor cell or an engineered chimeric antigen receptor cell. In such embodiments, the engineered cell co-expresses the SIP and the CAR or TCR.

Chimeric antigen receptors (CARs) are recombinant receptors that include an antigen-binding domain (ectodomain), a transmembrane domain and an intracellular signaling region (endodomain) that is capable of inducing or mediating an activation signal to the T cell after the antigen is bound. In some example, CAR-expressing cells are engineered to express an extracellular single chain variable fragment (scFv) with specificity for a particular tumor antigen linked to an intracellular signaling part comprising an activating domain and, in some cases, a costimulatory domain. The costimulatory domain can be derived from, e.g., CD28, OX-40, 4-1BB/CD137 or inducible T cell costimulator (ICOS). The activating domain can be derived from, e.g., CD3, such as CD3 zeta, epsilon, delta, gamma, or the like. In certain embodiments, the CAR is designed to have two, three, four, or more costimulatory domains. The CAR scFv can be designed to target an antigen expressed on a cell associated with a disease or condition, e.g. a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety.

In some aspects, the antigen-binding domain is an antibody or antigen-binding fragment thereof, such as a single chain fragment (scFv). In some embodiments, the antigen is expressed on a tumor or cancer cell. Exemplary of an antigen is CD19. Exemplary of a CAR is an anti-CD19 CAR, such as a CAR containing an anti-CD19 scFv set forth in SEQ ID NO: 245. In some embodiments, the CAR further contains a spacer, a transmembrane domain, and an intracellular signaling domain or region comprising an ITAM signaling domain, such as a CD3zeta signaling domain. In some embodiments, the CAR further includes a costimulatory signaling domain.

In some embodiments, the CAR further contains a spacer or hinge, a transmembrane domain, and an intracellular signaling domain (endodomain) comprising an ITAM signaling domain, such as a CD3zeta signaling domain. In some embodiments, the CAR further includes a costimulatory signaling domain. The costimulatory domain can be derived from, e.g., CD28, OX-40, 4-1BB/CD137 or inducible T cell costimulator (ICOS). In certain embodiments, the CAR is designed to have two, three, four, or more costimulatory domains. The CAR scFv can be designed to target an antigen expressed on a cell associated with a disease or condition, e.g. a tumor antigen, such as, for example, CD19, which is a transmembrane protein expressed by cells in the B cell lineage, including all normal B cells and B cell malignances, including but not limited to NHL, CLL, and non-T cell ALL. Example CAR+ T cell therapies and constructs are described in U.S. Patent Publication Nos. 2013/0287748, 2014/0227237, 2014/0099309, and 2014/0050708, and these references are incorporated by reference in their entirety. In some embodiments, the spacer or hinge is present between the antigen-binding domain and the transmembrane domain, such as is between the antigen-binding domain and plasma membrane when expressed on a cell. In some embodiments, the spacer or hinge is derived from IgG subclass (such as IgG1 and IgG4, IgD or CD8 (see e.g., Qin et al. (2017) J. Hematol. Oncol., 10:68). In some embodiments, the spacer or hinge is derived from IgG1.

In some embodiments, the spacer and transmembrane domain are the hinge and transmembrane domain derived from CD8, such as having an exemplary sequence set forth in SEQ ID NO: 246, 483, or 897 or a sequence of amino acids that exhibits at least 85%, 86%, 87%, 88%, 89%, 90%, 91%, 92%, 93%, 94%, 95%, 96%, 97%, 98%, 99% or more sequence identity to SEQ ID NO:246, 483, or 897. In some embodiments, the endodomain comprises at CD3-zeta signaling domain. In some embodiments, the CD3-zeta signaling domain comprises the sequence of amino acids set forth in SEQ ID NO: 243 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 247 and retains the activity of T cell signaling. In some embodiments, the endodomain of a CAR can further comprise a costimulatory signaling domain or region to further modulate immunomodulatory responses of the T-cell. In some embodiments, the costimulatory signaling domain is or comprises a costimulatory region, or is derived from a costimulatory region, of CD28, ICOS, 41BB or OX40. In some embodiments, the costimulatory signaling domain is a derived from CD28 or 4-1BB and comprises the sequence of amino acids set forth in any of SEQ ID NOS: 484-487 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO:484-487 and retains the activity of T cell costimulatory signaling.

Provided herein is a polynucleotide encoding an ICOSL polypeptide and encoding one or more proteins, such as a recombinant antigen receptor (e.g., chimeric antigen receptor (CAR) or engineered T cell receptor (TCR)), a marker, and one or more self-cleaving peptides. In some embodiments, the construct encoding the CAR further encodes a second protein, such as a marker, e.g. detectable protein, separated from the CAR by a self-cleaving peptide sequence. In some examples, the nucleic acid encoding the variant ICOSL polypeptide is separated from the one or more sequence(s) that is a nucleic acid encoding a protein, wherein the protein encodes a recombinant antigen receptor (e.g., CAR or TCR), a marker, a cytokine, or a chemokine. Any of the nucleotide sequences can be in a vector, such as viral vector. In some examples, the viral vector is a lentiviral vector or retroviral vector.

In some embodiments, the self-cleaving peptide sequence is an F2A, T2A, E2A or P2A self-cleaving peptide. Exemplary sequences of a T2A self-cleaving peptide are set for the in any one of SEQ ID NOS: 250, 488, 860-862 or a sequence of amino acids that exhibits at least 85%, 86%, 87%, 88%, 89%, 90%, 91%, 92%, 93%, 94%, 95%, 96%, 97%, 98% or 99% or more sequence identity to any of SEQ ID NOS: 250, 488, 860-862. In some embodiments, the T2A is encoded by the sequence of nucleotides set forth in SEQ ID NO:249 or a sequence that exhibits at least 85%, 86%, 87%, 88%, 89%, 90%, 91%, 92%, 93%, 94%, 95%, 96%, 97%, 98% or 99% or more sequence identity to any of SEQ ID NO: 249. An exemplary sequence of a P2A self-cleaving peptide is set in SEQ ID NO: 863 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NOS: 863. In some cases, a nucleic acid construct that encodes more than one P2A self-cleaving peptide (such as a P2A1 and P2A2), in which the nucleotide sequence P2A1 and P2A2 each encode the P2A set forth in SEQ ID NO:863, the nucleotide sequence may be different to avoid recombination between sequences.

In some embodiments, the marker is a detectable protein, such as a fluorescent protein, e.g., a green fluorescent protein (GFP) or blue fluorescent protein (BFP). Exemplary sequences of a fluorescent protein marker are set forth in SEQ ID NO:489, 858, 859, 903 or a sequence of amino acids that exhibits at least 85%, 86%, 87%, 88%, 89%, 90%, 91%, 92%, 93%, 94%, 95%, 96%, 97%, 98% or 99% or more sequence identity to SEQ ID NO: 489, 858, 859, 903.

In some embodiments, the CAR is an anti-CD19 CAR that has the sequence of amino acids set forth in any of SEQ ID NOS: 479, 490, 491, 492, 898, 899, 901, or 902 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NOS: 479, 490, 491, 492, 898, 899, 901, or 902. In some embodiments, the CAR is encoded by a sequence of nucleotides set forth in SEQ ID NO: 248 or 900 or a sequence of amino acids that exhibits at least 85%, 86%, 87%, 88%, 89%, 90%, 91%, 92%, 93%, 94%, 95%, 96%, 97%, 98% or 99% or more sequence identity to any one of SEQ ID NO: 248 or 900.

In another embodiment, the engineered T-cell possesses a TCR, including a recombinant or engineered TCR. In some embodiments, the TCR can be a native TCR. Those of skill in the art will recognize that generally native mammalian T-cell receptors comprise an alpha and a beta chain (or a gamma and a delta chain) involved in antigen specific recognition and binding. In some embodiments, the TCR is an engineered TCR that is modified. In some embodiments, the TCR of an engineered T-cell specifically binds to a tumor associated or tumor specific antigen presented by an APC.

In some embodiments, the immunomodulatory polypeptides, such as transmembrane immunomodulatory polypeptides or secretable immunomodulatory polypeptides, can be incorporated into engineered cells, such as engineered T cells or engineered APCs, by a variety of strategies such as those employed for recombinant host cells. A variety of methods to introduce a DNA construct into primary T cells are known in the art. In some embodiments, viral transduction or plasmid electroporation are employed. In typical embodiments, the nucleic acid molecule encoding the immunomodulatory protein, or the expression vector, comprises a signal peptide that localizes the expressed transmembrane immunomodulatory proteins to the cellular membrane or for secretion. In some embodiments, a nucleic acid encoding a transmembrane immunomodulatory proteins of the invention is sub-cloned into a viral vector, such as a retroviral vector, which allows expression in the host mammalian cell. The expression vector can be introduced into a mammalian host cell and, under host cell culture conditions, the immunomodulatory protein is expressed on the surface or is secreted.

In an exemplary example, primary T-cells can be purified ex vivo (CD4 cells or CD8 cells or both) and stimulated with an activation protocol consisting of various TCR/CD28 agonists, such as anti-CD3/anti-CD28 coated beads. After a 2 or 3 day activation process, a recombinant expression vector containing an immunomodulatory polypeptide can be stably introduced into the primary T cells through art standard lentiviral or retroviral transduction protocols or plasmid electroporation strategies. Cells can be monitored for immunomodulatory polypeptide expression by, for example, flow cytometry using anti-epitope tag or antibodies that cross-react with native parental molecule and polypeptides comprising variant ICOSL. T-cells that express the immunomodulatory polypeptide can be enriched through sorting with anti-epitope tag antibodies or enriched for high or low expression depending on the application.

Upon immunomodulatory polypeptide expression the engineered T-cell can be assayed for appropriate function by a variety of means. The engineered CAR or TCR co-expression can be validated to show that this part of the engineered T cell was not significantly impacted by the expression of the immunomodulatory protein. Once validated, standard in vitro cytotoxicity, proliferation, or cytokine assays (e.g., IFN-gamma expression) can be used to assess the function of engineered T-cells. Exemplary standard endpoints are percent lysis of the tumor line, proliferation of the engineered T-cell, or IFN-gamma protein expression in culture supernatants. An engineered construct which results in statistically significant increased lysis of tumor line, increased proliferation of the engineered T-cell, or increased IFN-gamma expression over the control construct can be selected for. Additionally, non-engineered, such as native primary or endogenous T-cells could also be incorporated into the same in vitro assay to measure the ability of the immunomodulatory polypeptide construct expressed on the engineered cells, such as engineered T-cells, to modulate activity, including, in some cases, to activate and generate effector function in bystander, native T-cells. Increased expression of activation markers such as CD69, CD44, or CD62L could be monitored on endogenous T cells, and increased proliferation and/or cytokine production could indicate desired activity of the immunomodulatory protein expressed on the engineered T cells.

In some embodiments, the similar assays can be used to compare the function of engineered T cells containing the CAR or TCR alone to those containing the CAR or TCR and a TIP construct. Typically, these in vitro assays are performed by plating various ratios of the engineered T cell and a "tumor" cell line containing the cognate CAR or TCR antigen together in culture. Standard endpoints are percent lysis of the tumor line, proliferation of the engineered T cell, or IFN-gamma production in culture supernatants. An engineered immunomodulatory protein which resulted in statistically significant increased lysis of tumor line, increased proliferation of the engineered T cell, or increased IFN-gamma production over the same TCR or CAR construct alone can be selected for.

Engineered human T cells can be analyzed in immuno-compromised mice, like the NSG strain, which lacks mouse T, NK and B cells. Engineered human T cells in which the CAR or TCR binds a target counter-structure on the xenograft and is co-expressed with the TIP affinity modified IgSF domain can be adoptively transferred in vivo at different cell numbers and ratios compared to the xenograft. For example, engraftment of CD19+ leukemia tumor lines containing a luciferase/GFP vector can be monitored through bioluminescence or ex vivo by flow cytometry. In a common embodiment, the xenograft is introduced into the murine model, followed by the engineered T cells several days later. Engineered T cells containing the immunomodulatory protein can be assayed for increased survival, tumor clearance, or expanded engineered T cells numbers relative to engineered T cells containing the CAR or TCR alone. As in the in vitro assay, endogenous, native (i.e., non-engineered) human T cells could be co-adoptively transferred to look for successful epitope spreading in that population, resulting in better survival or tumor clearance.

D. Infectious Agents Expressing Variant Polypeptides and Immunomodulatory Proteins Also provided are infectious agents that contain nucleic acids encoding any of the variant polypeptides, such as ICOSL vIgD polypeptides, including secretable or transmembrane immunomodulatory proteins described herein. In some embodiments, such infectious agents can deliver the nucleic acids encoding the variant immunomodulatory polypeptides described herein, such as ICOSL vIgD polypeptides, to a target cell in a subject, e.g., immune cell and/or antigen-presenting cell (APC) or tumor cell in a subject. Also provided are nucleic acids contained in such infectious agents, and/or nucleic acids for generation or modification of such infectious agents, such as vectors and/or plasmids, and compositions containing such infectious agents. In some embodiments, a variant ICOSL polypeptide is expressed in an infectious agent (e.g. viral or bacterial agent) which, upon administration to a subject, is able to infect a cell in vivo, such as an immune cell (e.g. T cell or antigen presenting cell) or tumor, for delivery or expression of the variant polypeptide as a TIP or a SIP in the cell.

In some embodiments, the infectious agent is a microorganism or a microbe. In some embodiments, the infectious agent is a virus or a bacterium. In some embodiments, the infectious agent is a virus. In some embodiments, the infectious agent is a bacterium. In some embodiments, such infectious agents can deliver nucleic acid sequences encoding any of the variant polypeptides, such as ICOSL vIgD polypeptides, including secretable or transmembrane immunomodulatory proteins, described herein. Thus, in some embodiments, the cell in a subject that is infected or contacted by the infectious agents can be rendered to express on the cell surface or secrete, the variant immunomodulatory polypeptides. In some embodiments, the infectious agent can also deliver one or more other therapeutics or nucleic acids encoding other therapeutics to the cell and/or to an environment within the subject. In some embodiments, other therapeutics that can be delivered by the infectious agents include cytokines or other immunomodulatory molecules.

In some embodiments, the infectious agent, e.g., virus or bacteria, contains nucleic acid sequences that encode any of the variant polypeptides, such as ICOSL vIgD polypeptides, including secretable or transmembrane immunomodulatory proteins, described herein, and by virtue of contact and/or infection of a cell in the subject, the cell expresses the variant polypeptides, such as ICOSL vIgD polypeptides, including secretable or transmembrane immunomodulatory proteins, encoded by the nucleic acid sequences contained in the infectious agent. In some embodiments, the infectious agent can be administered to the subject. In some embodiments, the infectious agent can be introduced to cells from the subject ex vivo.

In some embodiments, the variant polypeptides, such as ICOSL vIgD polypeptides, including transmembrane immunomodulatory proteins, expressed by the cell infected by the infectious agent is a transmembrane protein and is surface expressed. In some embodiments, the variant polypeptides, such as ICOSL vIgD polypeptides, including secretable immunomodulatory proteins, expressed by the cell infected by the infectious agent is expressed and secreted from the cell. The transmembrane immunomodulatory protein or secreted immunomodulatory protein can be any described herein.

In some embodiments, the cells in the subject that are targeted by the infectious agent include a tumor cell, an immune cell, and/or an antigen-presenting cell (APC). In some embodiments, the infectious agent targets a cell in the tumor microenvironment (TME). In some embodiments, the infectious agent delivers the nucleic acids encoding the variant polypeptides, such as ICOSL vIgD polypeptides, including secretable or transmembrane immunomodulatory proteins, to an appropriate cell (for example, an APC, such as a cell that displays a peptide/MHC complex on its cell surface, such as a dendritic cell) or tissue (e.g., lymphoid tissue) that modulate an immune response and/or a specific cell-medicated immune response, e.g., CD4 and/or CD8 T cell response, which CD8 T cell response may include a cytotoxic T cell (CTL) response. In some embodiments, the infectious agent targets an APC, such as a dendritic cell (DC). In some embodiments, the nucleic acid molecule delivered by the infectious agents described herein include appropriate nucleic acid sequences necessary for the expression of the operably linked coding sequences encoding the variant immunomodulatory polypeptides, in a particular target cell, e.g., regulatory elements such as promoters.

In some embodiments, the infectious agent that contains nucleic acid sequences encoding the immunomodulatory polypeptides can also contain nucleic acid sequences that encode one or more additional gene products, e.g., cytokines, prodrug converting enzymes, cytotoxins and/or detectable gene products. For example, in some embodiments, the infectious agent is an oncolytic virus and the virus can include nucleic acid sequences encoding additional therapeutic gene products (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588, 771, 7,662,398 and 7,754,221 and U.S. Pat. Publ. Nos. 2007/0202572, 2007/0212727, 2010/0062016, 2009/ 0098529, 2009/0053244, 2009/0155287, 2009/0117034, 2010/0233078, 2009/0162288, 2010/0196325, 2009/

0136917 and 2011/0064650. In some embodiments, the additional gene product can be a therapeutic gene product that can result in death of the target cell (e.g., tumor cell) or gene products that can augment or boost or regulate an immune response (e.g., cytokine). Exemplary gene products also include among an anticancer agent, an anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration and reprogramming human somatic cells to pluripotency, and other genes described herein or known to one of skill in the art. In some embodiments, the additional gene product is Granulocyte-macrophage colony-stimulating factor (GM-CSF).

1. Viruses

In some embodiments, the infectious agent is a virus. In some embodiments, the infectious agent is an oncolytic virus, or a virus that targets particular cells, e.g., immune cells. In some embodiments, the infectious agent targets a tumor cell and/or cancer cell in the subject. In some embodiments, the infectious agent targets an immune cell or an antigen-presenting cell (APC).

In some embodiments, the infectious agent is an oncolytic virus. Oncolytic viruses are viruses that accumulate in tumor cells and replicate in tumor cells. By virtue of replication in the tumor cells, and optional delivery of nucleic acids encoding variant ICOSL polypeptides or immunomodulatory polypeptides described herein, tumor cells are lysed, and the tumor shrinks and can be eliminated. Oncolytic viruses can also have a broad host and cell type range. For example, oncolytic viruses can accumulate in immunoprivilaged cells or immunoprivilaged tissues, including tumors and/or metastases, and also including wounded tissues and cells, thus allowing the delivery and expression of nucleic acids encoding the variant immunomodulatory polypeptides described herein in a broad range of cell types. Oncolytic viruses can also replicate in a tumor cell specific manner, resulting in tumor cell lysis and efficient tumor regression.

Exemplary oncolytic viruses include adenoviruses, adeno-associated viruses, herpes viruses, Herpes Simplex Virus, vesticular stomatic virus, Reovirus, Newcastle Disease virus, parvovirus, measles virus, vesticular stomatitis virus (VSV), Coxsackie virus and Vaccinia virus. In some embodiments, oncolytic viruses can specifically colonize solid tumors, while not infecting other organs, and can be used as an infectious agent to deliver the nucleic acids encoding the variant immunomodulatory polypeptides described herein to such solid tumors.

Oncolytic viruses for use in delivering the nucleic acids encoding variant ICOSL polypeptides or immunomodulatory polypeptides described herein, can be any of those known to one of skill in the art and include, for example, vesicular stomatitis virus, see, e.g., U.S. Pat. Nos. 7,731,974, 7,153,510, 6,653,103 and U.S. Pat. Pub. Nos. 2010/0178684, 2010/0172877, 2010/0113567, 2007/0098743, 20050260601, 20050220818 and EP Pat. Nos. 1385466, 1606411 and 1520175; herpes simplex virus, see, e.g., U.S. Pat. Nos. 7,897,146, 7,731,952, 7,550,296, 7,537,924, 6,723,316, 6,428,968 and U.S. Pat. Pub. Nos., 2014/0154216, 2011/0177032, 2011/0158948, 2010/0092515, 2009/0274728, 2009/0285860, 2009/0215147, 2009/0010889, 2007/0110720, 2006/0039894, 2004/0009604, 2004/0063094, International Patent Pub. Nos., WO 2007/052029, WO 1999/038955; retroviruses, see, e.g., U.S. Pat. Nos. 6,689,871, 6,635,472, 5,851,529, 5,716,826, 5,716,613 and U.S. Pat. Pub. No. 20110212530; vaccinia viruses, see, e.g., 2016/0339066, and adeno-associated viruses, see, e.g., U.S. Pat. Nos. 8,007,780, 7,968,340, 7,943,374, 7,906,111, 7,927,585, 7,811,814, 7,662,627, 7,241,447, 7,238,526, 7,172,893, 7,033,826, 7,001,765, 6,897,045, and 6,632,670.

Oncolytic viruses also include viruses that have been genetically altered to attenuate their virulence, to improve their safety profile, enhance their tumor specificity, and they have also been equipped with additional genes, for example cytotoxins, cytokines, prodrug converting enzymes to improve the overall efficacy of the viruses (see, e.g., Kim et al., (2009) Nat Rev Cancer 9:64-71; Garcia-Aragoncillo et al., (2010) Curr Opin Mol Ther 12:403-411; see U.S. Pat. Nos. 7,588,767, 7,588,771, 7,662,398 and 7,754,221 and U.S. Pat. Publ. Nos. 2007/0202572, 2007/0212727, 2010/0062016, 2009/0098529, 2009/0053244, 2009/0155287, 2009/0117034, 2010/0233078, 2009/0162288, 2010/0196325, 2009/0136917 and 2011/0064650). In some embodiments, the oncolytic viruses can be those that have been modified so that they selectively replicate in cancerous cells, and, thus, are oncolytic. For example, the oncolytic virus is an adenovirus that has been engineered to have modified tropism for tumor therapy and also as gene therapy vectors. Exemplary of such is ONYX-015, H101 and Ad5ΔCR (Hallden and Portella (2012) Expert Opin Ther Targets, 16:945-58) and TNFerade (McLoughlin et al. (2005) Ann. Surg. Oncol., 12:825-30), or a conditionally replicative adenovirus Oncorine®.

In some embodiments, the infectious agent is a modified herpes simplex virus. In some embodiments, the infectious agent is a modified version of Talimogene laherparepvec (also known as T-Vec, Imlygic or OncoVex GM-CSF), that is modified to contain nucleic acids encoding any of the variant ICOSL polypeptides or immunomodulatory polypeptides described herein. In some embodiments, the infectious agent is a modified herpes simplex virus that is described, e.g., in WO 2007/052029, WO 1999/038955, US 2004/0063094, US 2014/0154216, or, variants thereof.

In some embodiments, the infectious agent is a virus that targets a particular type of cells in a subject that is administered the virus, e.g., a virus that targets immune cells or antigen-presenting cells (APCs). Dendritic cells (DCs) are essential APCs for the initiation and control of immune responses. DCs can capture and process antigens, migrate from the periphery to a lymphoid organ, and present the antigens to resting T cells in a major histocompatibility complex (MHC)-restricted fashion. In some embodiments, the infectious agent is a virus that specifically can target DCs to deliver nucleic acids encoding the variant ICOSL polypeptide or immunomodulatory polypeptides for expression in DCs. In some embodiments, the virus is a lentivirus or a variant or derivative thereof, such as an integration-deficient lentiviral vector. In some embodiments, the virus is a lentivirus that is pseudotyped to efficiently bind to and productively infect cells expressing the cell surface marker dendritic cell-specific intercellular adhesion molecule-3-grabbing non-integrin (DC-SIGN), such as DCs. In some embodiments, the virus is a lentivirus pseudotyped with a Sindbis virus E2 glycoprotein or modified form thereof, such as those described in WO 2013/149167. In some embodiments, the virus allows for delivery and expression of a sequence of interest (e.g., a nucleic acid encoding any of the variant ICOSL polypeptides or immunomodulatory polypeptides described herein) to a DC. In some embodiments, the virus includes those described in WO 2008/011636, US 2011/0064763, Tareen et al. (2014) Mol. Ther., 22:575-587, or variants thereof. Exemplary of a dendritic cell-tropic vector platform is ZVex™.

2. Bacteria

In some embodiments, the infectious agent is a bacterium. For example, in some embodiments, the bacteria can deliver nucleic acids encoding any of the variant immunomodulatory polypeptides described herein, e.g., variant ICOSL polypeptide or immunomodulatory polypeptide, to a target cell in the subject, such as a tumor cell, an immune cell, an antigen-presenting cell and/or a phagocytic cell. In some embodiments, the bacterium can be preferentially targeted to a specific environment within a subject, such as a tumor microenvironment (TME), for expression and/or secretion of the variant immunomodulatory polypeptides and/or to target specific cells in the environment for expression of the variant immunomodulatory polypeptides.

In some embodiments, the bacterium delivers the nucleic acids to the cells via bacterial-mediated transfer of plasmid DNA to mammalian cells (also referred to as "bactofection"). For example, in some embodiments, delivery of genetic material is achieved through entry of the entire bacterium into target cells. In some embodiments, spontaneous or induced bacterial lysis can lead to the release of plasmid for subsequent eukaryotic cell expression. In some embodiments, the bacterium can deliver nucleic acids to non-phagocytic mammalian cells (e.g., tumor cells) and/or to phagocytic cells, e.g., certain immune cells and/or APCs. In some embodiments, the nucleic acids delivered by the bacterium can be transferred to the nucleus of the cell in the subject for expression. In some embodiments, the nucleic acids also include appropriate nucleic acid sequences necessary for the expression of the operably linked sequences encoding the variant immunomodulatory polypeptides in a particular host cell, e.g., regulatory elements such as promoters or enhancers. In some embodiments, the infectious agent that is a bacterium can deliver nucleic acids encoding the immunomodulatory proteins in the form of an RNA, such as a pre-made translation-competent RNA delivered to the cytoplasm of the target cell for translation by the target cell's machinery.

In some embodiments, the bacterium can replicate and lyse the target cells, e.g., tumor cells. In some embodiments, the bacterium can contain and/or release nucleic acid sequences and/or gene products in the cytoplasm of the target cells, thereby killing the target cell, e.g., tumor cell. In some embodiments, the infectious agent is bacterium that can replicate specifically in a particular environment in the subject, e.g., tumor microenvironment (TME). For example, in some embodiments, the bacterium can replicate specifically in anaerobic or hypoxic microenvironments. In some embodiments, conditions or factors present in particular environments, e.g., aspartate, serine, citrate, ribose or galactose produced by cells in the TME, can act as chemoattractants to attract the bacterium to the environment. In some embodiments, the bacterium can express and/or secrete the immunomodulatory proteins described herein in the environment, e.g., TME.

In some embodiments, the infectious agent is a bacterium that is a *Listeria* sp., a *Bifidobacterium* sp., an *Escherichia* sp., a *Clostridium* sp., a *Salmonella* sp., a *Shigella* sp., a *Vibrio* sp. or a *Yersinia* sp. In some embodiments, the bacterium is selected from among one or more of *Listeria monocytogenes, Salmonella typhimurium, Salmonella choleraesuis, Escherichia coli, Vibrio cholera, Clostridium perfringens, Clostridium butyricum, Clostridium novyi, Clostridium acetobutylicum, Bifidobacterium infantis, Bifidobacterium longum* and *Bifidobacterium adolescentis*. In some embodiments, the bacterium is an engineered bacterium. In some embodiments, the bacterium is an engineered bacterium such as those described in, e.g., Seow and Wood (2009) Molecular Therapy 17(5):767-777; Baban et al. (2010) Bioengineered Bugs 1:6, 385-394; Patyar et al. (2010) J Biomed Sci 17:21; Tangney et al. (2010) Bioengineered Bugs 1:4, 284-287; van Pijkeren et al. (2010) Hum Gene Ther. 21(4):405-416; WO 2012/149364; WO 2014/198002; U.S. Pat. Nos. 9,103,831; 9,453,227; US 2014/0186401; US 2004/0146488; US 2011/0293705; US 2015/0359909 and EP 3020816. The bacterium can be modified to deliver nucleic acid sequences encoding any of the variant immunomodulatory polypeptides, conjugates and/or fusions provided herein, and/or to express such variant immunomodulatory polypeptides in the subject.

IV. NUCLEIC ACIDS, VECTORS AND METHODS FOR PRODUCING THE POLYPEPTIDES OR CELLS

Provided herein are isolated or recombinant nucleic acids collectively referred to as "nucleic acids" which encode any of the various provided embodiments of the variant ICOSL polypeptides or immunomodulatory polypeptides provided herein. In some embodiments, nucleic acids provided herein, including all described below, are useful in recombinant production (e.g., expression) of variant ICOSL polypeptides or immunomodulatory polypeptides provided herein. In some embodiments, nucleic acids provided herein, including all described below, are useful in expression of variant ICOSL polypeptides or immunomodulatory polypeptides provided herein in cells, such as in engineered cells, e.g. immune cells, or infectious agent cells. The nucleic acids provided herein can be in the form of RNA or in the form of DNA, and include mRNA, cRNA, recombinant or synthetic RNA and DNA, and cDNA. The nucleic acids provided herein are typically DNA molecules, and usually double-stranded DNA molecules. However, single-stranded DNA, single-stranded RNA, double-stranded RNA, and hybrid DNA/RNA nucleic acids or combinations thereof comprising any of the nucleotide sequences of the invention also are provided.

Also provided herein are recombinant expression vectors and recombinant host cells useful in producing the variant ICOSL polypeptides or immunomodulatory polypeptides provided herein.

Also provided herein are engineered cells, such as engineered immune cells, containing any of the provided nucleic acid molecules or any of the variant ICOSL polypeptides or immunomodulatory polypeptides, such as any of the transmembrane immunomodulatory polypeptides or secretable immunomodulatory polypeptides.

Also provided herein are infectious agents, such as bacterial or viral cells, containing any of the provided nucleic acid molecules or any of the variant ICOSL polypeptides or immunomodulatory polypeptides, such as any of the transmembrane immunomodulatory polypeptides or secretable immunomodulatory polypeptides.

In any of the above provided embodiments, the nucleic acids encoding the variant polypeptides or immunomodulatory polypeptides provided herein can be introduced into cells using recombinant DNA and cloning techniques. To do so, a recombinant DNA molecule encoding an immunomodulatory polypeptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidite method. Also, a combination of these techniques could be used. In some instances, a recombinant or synthetic nucleic acid may be generated through polymerase chain reaction (PCR). In some embodiments, a DNA insert can be generated encoding one or more variant ICOSL polypeptides containing at least one affinity-modified IgSF domain and, in some embodiments, a signal peptide, a transmembrane domain and/or an endodomain in accord with the provided description. This DNA insert can be cloned into an appropriate transduction/transfection vector as is known to those of skill in the art. Also provided are expression vectors containing the nucleic acid molecules.

In some embodiments, the expression vectors are capable of expressing the immunomodulatory proteins in an appropriate cell under conditions suited to expression of the protein. In some aspects, nucleic acid molecule or an expression vector comprises the DNA molecule that encodes the immunomodulatory protein operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

In some embodiments, expression of the immunomodulatory protein is controlled by a promoter or enhancer to control or regulate expression. The promoter is operably linked to the portion of the nucleic acid molecule encoding the variant polypeptide or immunomodulatory protein. In some embodiments, the promotor is a constitutively active promotor (such as a tissue-specific constitutively active promotor or other constitutive promotor). In some embodiments, the promotor is an inducible promotor, which may be responsive to an inducing agent (such as a T cell activation signal).

In some embodiments, a constitutive promoter is operatively linked to the nucleic acid molecule encoding the variant polypeptide or immunomodulatory protein. Exemplary constitutive promoters include the Simian vacuolating virus 40 (SV40) promoter, the cytomegalovirus (CMV) promoter, the ubiquitin C (UbC) promoter, and the EF-1 alpha (EF1a) promoter. In some embodiments, the constitutive promoter is tissue specific. For example, in some embodiments, the promoter allows for constitutive expression of the immunomodulatory protein in specific tissues, such as immune cells, lymphocytes, or T cells. Exemplary tissue-specific promoters are described in U.S. Pat. No. 5,998,205, including, for example, a fetoprotein, DF3, tyrosinase, CEA, surfactant protein, and ErbB2 promoters.

In some embodiments, an inducible promoter is operatively linked to the nucleic acid molecule encoding the variant polypeptide or immunomodulatory protein such that expression of the nucleic acid is controllable by controlling the presence or absence of the appropriate inducer of transcription. For example, the promoter can be a regulated promoter and transcription factor expression system, such as the published tetracycline-regulated systems or other regulatable systems (see, e.g. published International PCT Appl. No. WO 01/30843), to allow regulated expression of the encoded polypeptide. An exemplary regulatable promoter system is the Tet-On (and Tet-Off) system available, for example, from Clontech (Palo Alto, Calif.). This promoter system allows the regulated expression of the transgene controlled by tetracycline or tetracycline derivatives, such as doxycycline. Other regulatable promoter systems are known (see e.g., published U.S. Application No. 2002-0168714, entitled "Regulation of Gene Expression Using Single-Chain, Monomeric, Ligand Dependent Polypeptide Switches," which describes gene switches that contain ligand binding domains and transcriptional regulating domains, such as those from hormone receptors).

In some embodiments, the promotor is responsive to an element responsive to T-cell activation signaling. Solely by way of example, in some embodiments, an engineered T cell comprises an expression vector encoding the immunomodulatory protein and a promotor operatively linked to control expression of the immunomodulatory protein. The engineered T cell can be activated, for example by signaling through an engineered T cell receptor (TCR) or a chimeric antigen rector (CAR), and thereby triggering expression and secretion of the immunomodulatory protein through the responsive promotor.

In some embodiments, an inducible promoter is operatively linked to the nucleic acid molecule encoding the immunomodulatory protein such that the immunomodulatory protein is expressed in response to a nuclear factor of activated T-cells (NFAT) or nuclear factor kappa-light-chain enhancer of activated B cells (NF-κB). For example, in some embodiments, the inducible promoter comprises a binding site for NFAT or NF-κB. For example, in some embodiments, the promoter is an NFAT or NF-κB promoter or a functional variant thereof. Thus, in some embodiments, the nucleic acids make it possible to control the expression of immunomodulatory protein while also reducing or eliminating the toxicity of the immunomodulatory protein. In particular, engineered immune cells comprising the nucleic acids of the invention express and secrete the immunomodulatory protein only when the cell (e.g., a T-cell receptor (TCR) or a chimeric antigen receptor (CAR) expressed by the cell) is specifically stimulated by an antigen and/or the cell (e.g., the calcium signaling pathway of the cell) is non-specifically stimulated by, e.g., phorbol myristate acetate (PMA)/Ionomycin. Accordingly, the expression and, in some cases, secretion, of immunomodulatory protein can be controlled to occur only when and where it is needed (e.g., in the presence of an infectious disease-causing agent, cancer, or at a tumor site), which can decrease or avoid undesired immunomodulatory protein interactions.

In some embodiments, the nucleic acid encoding an immunomodulatory protein described herein comprises a suitable nucleotide sequence that encodes a NFAT promoter, NF-κB promoter, or a functional variant thereof "NFAT promoter" as used herein means one or more NFAT responsive elements linked to a minimal promoter. "NF-κB promoter" refers to one or more NF-κB responsive elements linked to a minimal promoter. In some embodiments, the minimal promoter of a gene is a minimal human IL-2 promoter or a CMV promoter. The NFAT responsive elements may comprise, e.g., NFAT1, NFAT2, NFAT3, and/or NFAT4 responsive elements. The NFAT promoter, NF-κB promoter, or a functional variant thereof may comprise any number of binding motifs, e.g., at least two, at least three, at least four, at least five, or at least six, at least seven, at least eight, at least nine, at least ten, at least eleven, or up to twelve binding motifs.

The resulting recombinant expression vector having the DNA molecule thereon is used to transform an appropriate host. This transformation can be performed using methods well known in the art. In some embodiments, a nucleic acid provided herein further comprises nucleotide sequence that encodes a secretory or signal peptide operably linked to the nucleic acid encoding an immunomodulatory polypeptide such that a resultant soluble immunomodulatory polypeptide is recovered from the culture medium, host cell, or host cell periplasm. In other embodiments, the appropriate expression control signals are chosen to allow for membrane expression of an immunomodulatory polypeptide. Furthermore, commercially available kits as well as contract manufacturing companies can also be utilized to make engineered cells or recombinant host cells provided herein.

In some embodiments, the resulting expression vector having the DNA molecule thereon is used to transform, such as transduce, an appropriate cell. The introduction can be performed using methods well known in the art. Exemplary methods include those for transfer of nucleic acids encoding the receptors, including via viral, e.g., retroviral or lentiviral, transduction, transposons, and electroporation. In some embodiments, the expression vector is a viral vector. In some embodiments, the nucleic acid is transferred into cells by lentiviral or retroviral transduction methods.

Any of a large number of publicly available and well-known mammalian host cells, including mammalian T-cells or APCs, can be used in the preparing the polypeptides or engineered cells. The selection of a cell is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all cells can be equally effective for the expression of a particular DNA sequence.

In some embodiments, the host cells can be a variety of eukaryotic cells, such as in yeast cells, or with mammalian cells such as Chinese hamster ovary (CHO) or HEK293 cells. In some embodiments, the host cell is a suspension cell and the polypeptide is engineered or produced in cultured suspension, such as in cultured suspension CHO cells, e.g. CHO-S cells. In some examples, the cell line is a CHO cell line that is deficient in DHFR (DHFR−), such as DG44 and DUXB11. In some embodiments, the cell is deficient in glutamine synthase (GS), e.g. CHO-S cells, CHOK1 SV cells, and CHOZN((R)) GS−/− cells. In some embodiments, the CHO cells, such as suspension CHO cells, may be CHO-S-2H2 cells, CHO-S-clone 14 cells, or ExpiCHO-S cells.

In some embodiments, expressing the provided ICOSL polypeptides from CHO cells results in a more homogenous composition of produced proteins. In some embodiments, the provided ICOSL polypeptides results in a more homogenous product when the proteins are expressed from CHO cells compared to ICOSL polypeptides containing the full ECD reference sequence and/or containing the protease cleavage site (e.g., LQQN/LT). In some embodiments, at least 91%, 92%, 93%, 94%, 95%, 96%, 97%, 98%, or 99% of the composition of produced proteins containing an ICOSL variant polypeptide produced herein, have the same amino acid length or are the same size. Techniques to assess homogeneity of size include high performance liquid chromatography (HPLC), size exclusion chromatography, SDS page, or sequencing.

In some embodiments, host cells can also be prokaryotic cells, such as with *E. coli*. The transformed recombinant host is cultured under polypeptide expressing conditions, and then purified to obtain a soluble protein. Recombinant host cells can be cultured under conventional fermentation conditions so that the desired polypeptides are expressed. Such fermentation conditions are well known in the art. Finally, the polypeptides provided herein can be recovered and purified from recombinant cell cultures by any of a number of methods well known in the art, including ammonium sulfate or ethanol precipitation, acid extraction, anion or cation exchange chromatography, phosphocellulose chromatography, hydrophobic interaction chromatography, and affinity chromatography. Protein refolding steps can be used, as desired, in completing configuration of the mature protein. Finally, high performance liquid chromatography (HPLC) can be employed in the final purification steps.

In some embodiments, the cell is an immune cell, such as any described above in connection with preparing engineered cells. In some embodiments, such engineered cells are primary cells. In some embodiments, the engineered cells are autologous to the subject. In some embodiment, the engineered cells are allogeneic to the subject. In some embodiments, the engineered cells are obtained from a subject, such as by leukapheresis, and transformed ex vivo for expression of the immunomodulatory polypeptide, e.g. transmembrane immunomodulatory polypeptide or secretable immunomodulatory polypeptide.

Also provided are nucleic acids encoding any of the variant immunomodulatory polypeptides contained in infectious agents described herein. In some embodiments, the infectious agents deliver the nucleic acids to a cell in the subject, and/or permit expression of the encoded variant polypeptides in the cell. Also provided are nucleic acids that are used to generate, produce or modify such infectious agents. For example, in some embodiments, provided are vectors and/or plasmids that contain nucleic acids encoding the variant immunomodulatory polypeptides, for generation of the infectious agents, delivery to the cells in a subject and/or expression of the variant immunomodulatory polypeptides in the cells in the subject.

In some embodiments, the provided nucleic acids are recombinant viral or bacterial vectors containing nucleic acid sequences encoding the variant immunomodulatory polypeptides. In some embodiments, the recombinant vectors can be used to produce an infectious agent that contains nucleic acid sequences encoding the variant immunomodulatory polypeptides and/or to be delivered to a target cell in the subject for expression by the target cell. In some embodiments, the recombinant vector is an expression vector. In some embodiments, the recombinant vector includes appropriate sequences necessary for generation and/or production of the infectious agent and expression in the target cell.

In some embodiments, the recombinant vector is a plasmid or cosmid. Plasmid or cosmid containing nucleic acid sequences encoding the variant immunomodulatory polypeptides, as described herein, is readily constructed using standard techniques well known in the art. For generation of the infectious agent, the vector or genome can be constructed in a plasmid form that can then be transfected into a packaging or producer cell line or a host bacterium. The recombinant vectors can be generated using any of the recombinant techniques known in the art. In some embodiments, the vectors can include a prokaryotic origin of replication and/or a gene whose expression confers a detectable or selectable marker such as a drug resistance for propagation and/or selection in prokaryotic systems.

In some embodiments, the recombinant vector is a viral vector. Exemplary recombinant viral vectors include a lentiviral vector genome, poxvirus vector genome, vaccinia virus vector genome, adenovirus vector genome, adenovirus-associated virus vector genome, herpes virus vector genome, and alpha virus vector genome. Viral vectors can be live, attenuated, replication conditional or replication deficient, non-pathogenic (defective), replication competent viral vector, and/or is modified to express a heterologous gene product, e.g., the variant immunomodulatory polypeptides provided herein. Vectors for generation of viruses also can be modified to alter attenuation of the virus, which includes any method of increasing or decreasing the transcriptional or translational load.

Exemplary viral vectors that can be used include modified vaccinia virus vectors (see, e.g., Guerra et al., J. Virol. 80:985-98 (2006); Tartaglia et al., AIDS Research and Human Retroviruses 8: 1445-47 (1992); Gheradi et al., J. Gen. Virol. 86:2925-36 (2005); Mayr et al., Infection 3:6-14 (1975); Hu et al., J. Virol. 75: 10300-308 (2001); U.S. Pat. Nos. 5,698,530, 6,998,252, 5,443,964, 7,247,615 and 7,368,116); adenovirus vector or adenovirus-associated virus vectors (see, e.g., Molin et al., J. Virol. 72:8358-61 (1998); Narumi et al., Am J. Respir. Cell Mol. Biol. 19:936-41 (1998); Mercier et al., Proc. Natl. Acad. Sci. USA 101:6188-93 (2004); U.S. Pat. Nos. 6,143,290; 6,596,535; 6,855,317; 6,936,257; 7,125,717; 7,378,087; 7,550,296); retroviral vectors including those based upon murine leukemia virus (MuLV), gibbon ape leukemia virus (GaLV), ecotropic retroviruses, simian immunodeficiency virus (SIV), human immunodeficiency virus (HIV), and combinations (see, e.g., Buchscher et al., J. Virol. 66:2731-39 (1992); Johann et al., J. Virol. 66: 1635-40 (1992); Sommerfelt et al., Virology 176:58-59 (1990); Wilson et al., J. Virol. 63:2374-78 (1989); Miller et al., J. Virol. 65:2220-24 (1991); Miller et al., Mol. Cell Biol. 10:4239 (1990); Kolberg, N I H Res. 4:43 1992; Cornetta et al., Hum. Gene Ther. 2:215 (1991)); lentiviral vectors including those based upon Human Immunodeficiency Virus (HIV-1), HIV-2, feline immunodeficiency virus (FIV), equine infectious anemia virus, Simian Immunodeficiency Virus (SIV), and maedi/visna virus (see, e.g., Pfeifer et al., Annu. Rev. Genomics Hum. Genet. 2: 177-211 (2001); Zufferey et al., J. Virol. 72: 9873, 1998; Miyoshi et al., J. Virol. 72:8150, 1998; Philpott and Thrasher, Human Gene Therapy 18:483, 2007; Engelman et al., J. Virol. 69: 2729, 1995; Nightingale et al., Mol. Therapy, 13: 1121, 2006; Brown et al., J. Virol. 73:9011 (1999); WO 2009/076524; WO 2012/141984; WO 2016/011083; McWilliams et al., J. Virol. 77: 11150, 2003; Powell et al., J. Virol. 70:5288, 1996) or any, variants thereof, and/or vectors that can be used to generate any of the viruses described above. In some embodiments, the recombinant vector can include regulatory sequences, such as promoter or enhancer sequences, that can regulate the expression of the viral genome, such as in the case for RNA viruses, in the packaging cell line (see, e.g., U.S. Pat. Nos. 5,385,839 and 5,168,062).

In some embodiments, the recombinant vector is an expression vector, e.g., an expression vector that permits expression of the encoded gene product when delivered into the target cell, e.g., a cell in the subject, e.g., a tumor cell, an immune cell and/or an APC. In some embodiments, the recombinant expression vectors contained in the infectious agent are capable of expressing the immunomodulatory proteins in the target cell in the subject, under conditions suited to expression of the protein.

In some aspects, nucleic acids or an expression vector comprises a nucleic acid sequence that encodes the immunomodulatory protein operatively linked to appropriate expression control sequences. Methods of affecting this operative linking, either before or after the nucleic acid sequence encoding the immunomodulatory protein is inserted into the vector, are well known. Expression control sequences include promoters, activators, enhancers, operators, ribosomal binding sites, start signals, stop signals, cap signals, polyadenylation signals, and other signals involved with the control of transcription or translation. The promoter can be operably linked to the portion of the nucleic acid sequence encoding the immunomodulatory protein. In some embodiments, the promoter is a constitutively active promotor in the target cell (such as a tissue-specific constitutively active promotor or other constitutive promotor). For example, the recombinant expression vector may also include, lymphoid tissue-specific transcriptional regulatory elements (TRE) such as a B lymphocyte, T lymphocyte, or dendritic cell specific TRE. Lymphoid tissue specific TRE are known in the art (see, e.g., Thompson et al., Mol. Cell. Biol. 12:1043-53 (1992); Todd et al., J. Exp. Med. 177: 1663-74 (1993); Penix et al., J. Exp. Med. 178:1483-96 (1993)). In some embodiments, the promotor is an inducible promoter, which may be responsive to an inducing agent (such as a T cell activation signal). In some embodiments, nucleic acids delivered to the target cell in the subject, e.g., tumor cell, immune cell and/or APC, can be operably linked to any of the regulatory elements described above.

In some embodiments, the vector is a bacterial vector, e.g., a bacterial plasmid or cosmid. In some embodiments, the bacterial vector is delivered to the target cell, e.g., tumor cells, immune cells and/or APCs, via bacterial-mediated transfer of plasmid DNA to mammalian cells (also referred to as "bactofection"). In some embodiments, the delivered bacterial vector also contains appropriate expression control sequences for expression in the target cells, such as a promoter sequence and/or enhancer sequences, or any regulatory or control sequences described above. In some embodiments, the bacterial vector contains appropriate expression control sequences for expression and/or secretion of the encoded variant polypeptides in the infectious agent, e.g., the bacterium.

In some embodiments, polypeptides provided herein can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Peptides can then be assembled into the polypeptides as provided herein.

V. METHODS OF ASSESSING ACTIVITY IMMUNE MODULATION OF VARIANT ICOSL POLYPEPTIDES AND IMMUNOMODULATORY PROTEINS

In some embodiments, the variant ICOSL polypeptides provided herein (e.g. full-length and/or specific binding fragments or conjugates, stack constructs or fusion thereof) exhibit immunomodulatory activity to modulate T cell activation. In some embodiments, ICOSL polypeptides modulate IFN-gamma expression in a primary T cell assay relative to a reference (e.g., unmodified) or wild-type ICOSL control. In some cases, modulation of IFN-gamma expression can increase or decrease IFN-gamma expression relative to the control. Assays to determine specific binding and IFN-gamma expression are well-known in the art and include the MLR (mixed lymphocyte reaction) assays measuring interferon-gamma cytokine levels in culture supernatants (Wang et al., Cancer Immunol Res. 2014 September: 2(9):846-56), SEB (staphylococcal enterotoxin B) T cell stimulation assay (Wang et al., Cancer Immunol Res. 2014 September: 2(9): 846-56), and anti-CD3 T cell stimulation assays (Li and Kurlander, J Transl Med. 2010: 8: 104).

In some embodiments, a variant ICOSL polypeptide can in some embodiments increase or, in alternative embodiments, decrease IFN-gamma (interferon-gamma) expression in a primary T-cell assay relative to a wild-type ICOSL control. In some embodiments of the provided polypeptides containing a soluble variant ICOSL sequence, the polypeptide can increase IFN-gamma expression and, in alternative embodiments, decrease IFN-gamma expression in a primary T-cell assay relative to a wild-type ICOSL control. In some embodiments of the provided polypeptides containing multiple variant ICOSL sequences, the polypeptide can increase IFN-gamma expression and, in alternative embodiments, decrease IFN-gamma expression in a primary T-cell assay relative to a wild-type ICOSL control.

Those of skill will recognize that the format of the primary T-cell assay used to determine an increase in IFN-gamma expression can differ from that employed to assay for a decrease in IFN-gamma expression. In assaying for the ability of a variant ICOSL to decrease IFN-gamma expression in a primary T-cell assay, a Mixed Lymphocyte Reaction (MLR) assay can be used as described in Example 6. In some cases, a soluble form of a variant ICOSL can be employed to determine the ability of the variant ICOSL to antagonize and thereby decrease the IFN-gamma expression in a MLR as likewise described in Example 6.

Alternatively, in assaying for the ability of a variant ICOSL to increase IFN-gamma expression in a primary T-cell assay, a co-immobilization assay can be used as described in Example 6. In a co-immobilization assay, a TCR signal, provided in some embodiments by anti-CD3 antibody, is used in conjunction with a co-immobilized variant ICOSL to determine the ability to increase IFN-gamma expression relative to an ICOSL control. In some cases, a soluble form of a variant ICOSL that is multimerized to a degree to provide multivalent binding can be employed to determine the ability of the variant ICOSL to agonize and thereby increase the IFN-gamma expression in a MLR as likewise described in Example 6.

In some embodiments, in assaying for the ability of a variant ICOSL to modulate an increase or decrease IFN-gamma expression a T cell reporter assay can be used. In some embodiments, the T cell is a Jurkat T cell line or is derived from Jurkat T cell lines. In reporter assays, the reporter cell line (e.g. Jurkat reporter cell) also is generated to overexpress an inhibitory receptor that is the cognate binding partner of the variant IgSF domain polypeptide. In some embodiments, the reporter T cells also contain a reporter construct containing an inducible promoter responsive to T cell activation operably linked to a reporter. In some embodiments, the reporter is a fluorescent or luminescent reporter. In some embodiments, the reporter is luciferase. In some embodiments, the promoter is responsive to CD3 signaling. In some embodiments, the promoter is an NFAT promoter. In some embodiments, the promoter is responsive to costimulatory signaling, e.g. CD28 costimulatory signaling. In some embodiments, the promoter is an IL-2 promoter.

In aspects of a reporter assay, a reporter cell line is stimulated, such as by co-incubation with antigen presenting cells (APCs) expressing the wild-type ligand of the inhibitory receptor, e.g. ICOSL. In some embodiments, the APCs are artificial APCs. Artificial APCs are well known to a skilled artisan. In some embodiments, artificial APCs are derived from one or more mammalian cell line, such as K562, CHO or 293 cells.

In some embodiments, the Jurkat reporter cells are co-incubated with artificial APCs overexpressing the inhibitory ligand in the presence of the variant IgSF domain molecule or immunomodulatory protein, e.g., variant ICOSL polypeptide or immunomodulatory protein. In some embodiments, reporter expression is monitored, such as by determining the luminescence or fluorescence of the cells. In some embodiments, normal interactions between its inhibitory receptor and ligand result in a repression of or decrease in the reporter signal, such as compared to control, e.g. reporter expression by co-incubation of control T cells and APCs in which the inhibitory receptor and ligand interaction is not present, e.g. APCs that do not overexpress ICOSL. In some embodiments, a variant ICOSL polypeptide or immunomodulatory protein provided herein antagonizes the interaction, e.g. when provided in soluble form as a variant ICOSL-Fc or when expressed from the APC as a secretable immunomodulatory protein, thereby resulting in an increase in the reporter signal compared to the absence of the variant ICOSL polypeptide or immunomodulatory protein. In some cases, certain formats of a variant ICOSL polypeptide or immunomodulatory protein as provided herein may provide an agonist activity, thereby decreasing reporter expression compared to the absence of the variant ICOSL polypeptide or immunomodulatory protein.

Use of proper controls is known to those of skill in the art, however, in the aforementioned embodiments, the control typically involves use of the reference ICOSL, such as a wild-type of native ICOSL isoform from the same mammalian species from which the variant ICOSL was derived or developed. Irrespective of whether the binding affinity to either one or both of ICOS and CD28 is increased or decreased, a variant ICOSL in some embodiments will increase IFN-gamma expression and, in alternative embodiments, decrease IFN-gamma expression in a primary T-cell assay relative to a wild-type ICOSL control.

In some embodiments, a variant ICOSL increases IFN-gamma expression (i.e., protein expression) relative to a reference (e.g., unmodified) or wild-type ICOSL control by at least: 5%, 10%, 20%, 30%, 40%, 50%, 60%, 70%, 80%, 90%, or higher. In other embodiments, a variant ICOSL decreases IFN-gamma expression (i.e. protein expression) relative to a wild-type or unmodified ICOSL control by at least: 5%, 10%, 20%, 30%, 40%, 50%, 60%, 70%, 80%, 90%, or higher. In some embodiments, the wild-type ICOSL control is murine ICOSL, such as would typically be used for a variant ICOSL altered in sequence from that of a wild-type murine ICOSL sequence. In some embodiments, the wild-type ICOSL control is human ICOSL, such as would typically be used for a variant ICOSL altered in sequence from that of a wild-type human ICOSL sequence such as an ICOSL sequence comprising the sequence of amino acids of SEQ ID NO:32 or SEQ ID NO:196 or 545.

VI. PHARMACEUTICAL FORMULATIONS

Provided herein are compositions containing any of the variant ICOSL polypeptides, immunodulatory proteins, conjugates, engineered cells or infectious agents described herein. The pharmaceutical composition can further comprise a pharmaceutically acceptable excipient. For example, the pharmaceutical composition can contain one or more excipients for modifying, maintaining or preserving, for example, the pH, osmolarity, viscosity, clarity, color, isotonicity, odor, sterility, stability, rate of dissolution or release, adsorption, or penetration of the composition. In some aspects, a skilled artisan understands that a pharmaceutical composition containing cells may differ from a pharmaceutical composition containing a protein.

In some embodiments, the pharmaceutical composition is a solid, such as a powder, capsule, or tablet. For example, the components of the pharmaceutical composition can be lyophilized. In some embodiments, the solid pharmaceutical composition is reconstituted or dissolved in a liquid prior to administration.

In some embodiments, the pharmaceutical composition is a liquid, for example variant ICOSL polypeptides dissolved in an aqueous solution (such as physiological saline or Ringer's solution). In some embodiments, the pH of the pharmaceutical composition is between about 4.0 and about 8.5 (such as between about 4.0 and about 5.0, between about 4.5 and about 5.5, between about 5.0 and about 6.0, between about 5.5 and about 6.5, between about 6.0 and about 7.0, between about 6.5 and about 7.5, between about 7.0 and about 8.0, or between about 7.5 and about 8.5).

In some embodiments, the pharmaceutical composition comprises a pharmaceutically-acceptable excipient, for example a filler, binder, coating, preservative, lubricant, flavoring agent, sweetening agent, coloring agent, a solvent, a buffering agent, a chelating agent, or stabilizer. Examples of pharmaceutically-acceptable fillers include cellulose, dibasic calcium phosphate, calcium carbonate, microcrystalline cellulose, sucrose, lactose, glucose, mannitol, sorbitol, maltol, pregelatinized starch, corn starch, or potato starch. Examples of pharmaceutically-acceptable binders include polyvinylpyrrolidone, starch, lactose, xylitol, sorbitol, maltitol, gelatin, sucrose, polyethylene glycol, methyl cellulose, or cellulose. Examples of pharmaceutically-acceptable coatings include hydroxypropyl methylcellulose (HPMC), shellac, corn protein zein, or gelatin. Examples of pharmaceutically-acceptable disintegrants include polyvinylpyrrolidone, carboxymethyl cellulose, or sodium starch glycolate. Examples of pharmaceutically-acceptable lubricants include polyethylene glycol, magnesium stearate, or stearic acid. Examples of pharmaceutically-acceptable preservatives include methyl parabens, ethyl parabens, propyl paraben, benzoic acid, or sorbic acid. Examples of pharmaceutically-acceptable sweetening agents include sucrose, saccharine, aspartame, or sorbitol. Examples of pharmaceutically-acceptable buffering agents include carbonates, citrates, gluconates, acetates, phosphates, or tartrates.

In some embodiments, the pharmaceutical composition further comprises an agent for the controlled or sustained release of the product, such as injectable microspheres, bio-erodible particles, polymeric compounds (polylactic acid, polyglycolic acid), beads, or liposomes.

In some embodiments, the pharmaceutical composition is sterile. Sterilization may be accomplished by filtration through sterile filtration membranes or radiation. Where the composition is lyophilized, sterilization using this method may be conducted either prior to or following lyophilization and reconstitution. The composition for parenteral administration may be stored in lyophilized form or in solution. In addition, parenteral compositions generally are placed into a container having a sterile access port, for example, an intravenous solution bag or vial having a stopper pierceable by a hypodermic injection needle.

In some embodiments, provided are pharmaceutical compositions containing the transmembrane immunomodulatory proteins, including engineered cells expressing such transmembrane immunomodulatory proteins. In some embodiments, the pharmaceutical compositions and formulations include one or more optional pharmaceutically acceptable carrier or excipient. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the present invention are preferably formulated for intravenous administration.

In some embodiments, the pharmaceutical composition contains infectious agents containing nucleic acid sequences encoding the immunomodulatory variant polypeptides. In some embodiments, the pharmaceutical composition contains a dose of infectious agents suitable for administration to a subject that is suitable for treatment. In some embodiments, the pharmaceutical composition contains an infectious agent that is a virus, at a single or multiple dosage amount, of between about between or between about $1\times10^5$ and about $1\times10^{12}$ plaque-forming units (pfu), $1\times10^6$ and $1\times10^{10}$ pfu, or $1\times10^7$ and $1\times10^{10}$ pfu, each inclusive, such as at least or at least about or at about $1\times10^6$, $1\times10^7$, $1\times10^8$, $1\times10^9$, $2\times10^9$, $3\times10^9$, $4\times10^9$, $5\times10^9$ pfu or about $1\times10^{10}$ pfu. In some embodiments, the pharmaceutical composition can contain a virus concentration of from or from about $10^5$ to about $10^{10}$ pfu/mL, for example, $5\times10^6$ to $5\times10^9$ or $1\times10^7$ to $1\times10^9$ pfu/mL, such as at least or at least about or at about $10^6$ pfu/mL, $10^7$ pfu/mL, $10^8$ pfu/mL or $10^9$ pfu/mL. In some embodiments, the pharmaceutical composition contains an infectious agent that is a bacterium, at a single or multiple dosage amount, of between about between or between about $1\times10^3$ and about $1\times10^9$ colony-forming units (cfu), $1\times10^4$ and $1\times10^9$ cfu, or $1\times10^5$ and $1\times10^7$ cfu, each inclusive, such as at least or at least about or at about $1\times10^4$, $1\times10^5$, $1\times10^6$, $1\times10^7$, $1\times10^8$ or $1\times10^9$ cfu. In some embodiments, the pharmaceutical composition can contain a bacterial concentration of from or from about $10^3$ to about $10^8$ cfu/mL, for example, $5\times10^5$ to $5\times10^7$ or $1\times10^6$ to $1\times10^7$ cfu/mL, such as at least or at least about or at about $10^5$ cfu/mL, $10^6$ cfu/mL, $10^7$ cfu/mL or $10^8$ cfu/mL Such a formulation may, for example, be in a form suitable for intravenous infusion. A pharmaceutically acceptable carrier may be a pharmaceutically acceptable material, composition, or vehicle that is involved in carrying or transporting cells of interest from one tissue, organ, or portion of the body to another tissue, organ, or portion of the body. For example, the carrier may be a liquid or solid filler, diluent, excipient, solvent, or encapsulating material, or some combination thereof. Each component of the carrier must be "pharmaceutically acceptable" in that it must be compatible with the other ingredients of the formulation. It also must be suitable for contact with any tissue, organ, or portion of the body that it may encounter, meaning that it must not carry a risk of toxicity, irritation, allergic response, immunogenicity, or any other complication that excessively outweighs its therapeutic benefits.

In some embodiments, the pharmaceutical composition is administered to a subject. Generally, dosages and routes of administration of the pharmaceutical composition are determined according to the size and condition of the subject, according to standard pharmaceutical practice. For example, the therapeutically effective dose can be estimated initially either in cell culture assays or in animal models such as mice, rats, rabbits, dogs, pigs, or monkeys. An animal model may also be used to determine the appropriate concentration range and route of administration. Such information can then be used to determine useful doses and routes for administration in humans. The exact dosage will be determined in light of factors related to the subject requiring treatment. Dosage and administration are adjusted to provide sufficient levels of the active compound or to maintain the desired effect. Factors that may be taken into account include the severity of the disease state, the general health of the subject, the age, weight, and gender of the subject, time and frequency of administration, drug combination(s), reaction sensitivities, and response to therapy.

Long-acting pharmaceutical compositions may be administered every 3 to 4 days, every week, or biweekly depending on the half-life and clearance rate of the particular formulation. The frequency of dosing will depend upon the pharmacokinetic parameters of the molecule in the formulation used. Typically, a composition is administered until a dosage is reached that achieves the desired effect. The composition may therefore be administered as a single dose, or as multiple doses (at the same or different concentrations/dosages) over time, or as a continuous infusion. Further refinement of the appropriate dosage is routinely made. Appropriate dosages may be ascertained through use of appropriate dose-response data. A number of biomarkers or physiological markers for therapeutic effect can be monitored including T cell activation or proliferation, cytokine synthesis or production (e.g., production of TNF-α, IFN-γ, IL-2), induction of various activation markers (e.g., CD25, IL-2 receptor), inflammation, joint swelling or tenderness, serum level of C-reactive protein, anti-collagen antibody production, and/or T cell-dependent antibody response(s).

In some embodiments, the pharmaceutical composition is administered to a subject through any route, including orally, transdermally, by inhalation, intravenously, intra-arterially, intramuscularly, direct application to a wound site, application to a surgical site, intraperitoneally, by suppository, subcutaneously, intradermally, transcutaneously, by nebulization, intrapleurally, intraventricularly, intra-articularly, intraocularly, or intraspinally.

In some embodiments, the dosage of the pharmaceutical composition is a single dose or a repeated dose. In some embodiments, the doses are given to a subject once per day, twice per day, three times per day, or four or more times per day. In some embodiments, about 1 or more (such as about 2 or more, about 3 or more, about 4 or more, about 5 or more, about 6 or more, or about 7 or more) doses are given in a week. In some embodiments, multiple doses are given over the course of days, weeks, months, or years. In some embodiments, a course of treatment is about 1 or more doses (such as about 2 or more does, about 3 or more doses, about 4 or more doses, about 5 or more doses, about 7 or more doses, about 10 or more doses, about 15 or more doses, about 25 or more doses, about 40 or more doses, about 50 or more doses, or about 100 or more doses).

In some embodiments, an administered dose of the pharmaceutical composition is about 1 µg of protein per kg subject body mass or more (such as about 2 µg of protein per kg subject body mass or more, about 5 µg of protein per kg subject body mass or more, about 10 µg of protein per kg subject body mass or more, about 25 µg of protein per kg subject body mass or more, about 50 µg of protein per kg subject body mass or more, about 100 µg of protein per kg subject body mass or more, about 250 µg of protein per kg subject body mass or more, about 500 µg of protein per kg subject body mass or more, about 1 mg of protein per kg subject body mass or more, about 2 mg of protein per kg subject body mass or more, or about 5 mg of protein per kg subject body mass or more).

In some embodiments, a therapeutic amount of a cell composition is administered. Typically, precise amount of the compositions of the present invention to be administered can be determined by a physician with consideration of individual differences in age, weight, tumor size, extent of infection or metastasis, and condition of the patient (subject). It can generally be stated that a pharmaceutical composition comprising engineered cells, e.g. T cells, as described herein may be administered at a dosage of $10^4$ to $10^9$ cells/kg body weight, such as $10^5$ to $10^6$ cells/kg body weight, including all integer values within those ranges. Engineered cell compositions, such as T cell compositions, may also be administered multiple times at these dosages. The cells can be administered by using infusion techniques that are commonly known in immunotherapy (see, e.g., Rosenberg et al, New Eng. J. of Med. 319: 1676, 1988). The optimal dosage and treatment regime for a particular patient can readily be determined by one skilled in the art of medicine by monitoring the patient for signs of disease and adjusting the treatment accordingly.

A variety of means are known for determining if administration of a therapeutic composition of the invention sufficiently modulates immunological activity by eliminating, sequestering, or inactivating immune cells mediating or capable of mediating an undesired immune response; inducing, generating, or turning on immune cells that mediate or are capable of mediating a protective immune response; changing the physical or functional properties of immune cells; or a combination of these effects. Examples of measurements of the modulation of immunological activity include, but are not limited to, examination of the presence or absence of immune cell populations (using flow cytometry, immunohistochemistry, histology, electron microscopy, polymerase chain reaction (PCR)); measurement of the functional capacity of immune cells including ability or resistance to proliferate or divide in response to a signal (such as using T-cell proliferation assays and pepscan analysis based on 3H-thymidine incorporation following stimulation with anti-CD3 antibody, anti-T-cell receptor antibody, anti-CD28 antibody, calcium ionophores, PMA (phorbol 12-myristate 13-acetate) antigen presenting cells loaded with a peptide or protein antigen; B cell proliferation assays); measurement of the ability to kill or lyse other cells (such as cytotoxic T cell assays); measurements of the cytokines, chemokines, cell surface molecules, antibodies and other products of the cells (e.g., by flow cytometry, enzyme-linked immunosorbent assays, Western blot analysis, protein microarray analysis, immunoprecipitation analysis); measurement of biochemical markers of activation of immune cells or signaling pathways within immune cells (e.g., Western blot and immunoprecipitation analysis of tyrosine, serine or threonine phosphorylation, polypeptide cleavage, and formation or dissociation of protein complexes; protein array analysis; DNA transcriptional, profiling using DNA arrays or subtractive hybridization); measurements of cell death by apoptosis, necrosis, or other mechanisms (e.g., annexin V staining, TUNEL assays, gel electrophoresis to measure DNA laddering, histology; fluorogenic caspase assays, Western blot analysis of caspase substrates); measurement of the genes, proteins, and other molecules produced by immune cells (e.g., Northern blot analysis, polymerase chain reaction, DNA microarrays, protein microarrays, 2-dimensional gel electrophoresis, Western blot analysis, enzyme linked immunosorbent assays, flow cytometry); and measurement of clinical symptoms or outcomes such as improvement of autoimmune, neurodegenerative, and other diseases involving self-proteins or selfpolypeptides (clinical scores, requirements for use of additional therapies, functional status, imaging studies) for example, by measuring relapse rate or disease severity (using clinical scores known to the ordinarily skilled artisan) in the case of multiple sclerosis, measuring blood glucose in the case of type I diabetes, or joint inflammation in the case of rheumatoid arthritis.

VII. ARTICLES OF MANUFACTURE AND KITS

Also provided herein are articles of manufacture comprising the pharmaceutical compositions described herein in suitable packaging. Suitable packaging for compositions (such as ophthalmic compositions) described herein are known in the art, and include, for example, vials (such as sealed vials), vessels, ampules, bottles, jars, flexible packaging (e.g., sealed Mylar or plastic bags), and the like. These articles of manufacture may further be sterilized and/or sealed.

Further provided are kits comprising the pharmaceutical compositions (or articles of manufacture) described herein, which may further comprise instruction(s) on methods of using the composition, such as uses described herein. The kits described herein may also include other materials desirable from a commercial and user standpoint, including other buffers, diluents, filters, needles, syringes, and package inserts with instructions for performing any methods described herein.

VIII. THERAPEUTIC APPLICATIONS

The pharmaceutical compositions described herein (including pharmaceutical composition comprising the variant ICOSL polypeptides, the immunomodulatory proteins, the conjugates, the engineered cells and infectious agents described herein) can be used in a variety of therapeutic applications, such as the treatment of a disease. For example, in some embodiments the pharmaceutical composition is used to treat inflammatory or autoimmune disorders, cancer, organ transplantation, viral infections, and/or bacterial infections in a mammal. The pharmaceutical composition can modulate (e.g. increase or decrease) an immune response to treat the disease.

Such methods and uses include therapeutic methods and uses, for example, involving administration of the molecules or engineered cells, or compositions containing the same, to a subject having a disease, condition, or disorder. In some cases, such as described, the disease or disorder is an autoimmune or inflammatory disease or disorder. In some cases, such as described, the disease or disorder is a tumor or cancer. In some embodiments, the molecule or engineered cell is administered in an effective amount to effect treatment of the disease or disorder. Uses include uses of molecules containing a variant ICOSL polypeptide, immunomodulatory protein, conjugate, engineered cell and infectious agents in such methods and treatments, and in the preparation of a medicament in order to carry out such therapeutic methods. In some embodiments, the methods are carried out by administering a variant ICOSL polypeptide, immunomodulatory protein, conjugate, engineered cell, and infectious agent, or compositions comprising the same, to the subject having or suspected of having the disease or condition. In some embodiments, the methods thereby treat the disease or condition or disorder in the subject.

In some embodiments, the provided methods are applicable to therapeutic administration of variant ICOSL polypeptides, the immunomodulatory proteins, the conjugates, the engineered cells and infectious agents described herein. It is within the level of a skilled artisan, in view of the provided disclosure, to choose a format for the indication depending on the type of modulation of the immune response, e.g. increase or decrease that is desired.

In some embodiments, a pharmaceutical composition provided herein that stimulates the immune response is administered, which can be useful, for example, in the treatment of cancer, viral infections, or bacterial infections. In some embodiments, the pharmaceutical composition contains a variant ICOSL polypeptide in a format that exhibits agonist activity of its cognate binding partner CD28 or ICOS and/or that stimulates or initiates costimulatory signaling via CD28 or ICOS. Exemplary formats of an ICOSL polypeptide for use in connection with such therapeutic applications include, for example, an immunomodulatory protein or "stack" of a variant ICOSL polypeptide and an IgSF domain or variant thereof that binds to a tumor antigen (e.g. Nkp30 or affinity-modified variant) (also called a "tumor-localizing IgSF domain), a conjugate containing a variant ICOSL polypeptide linked to a tumor-targeting moiety (also called a tumor-localizing moiety), an engineered cell expressing a transmembrane immunomodulatory protein or an infectious agent comprising a nucleic acid molecule encoding a transmembrane immunomodulatory protein, such as for expression of the transmembrane immunomodulatory protein in an infected cell (e.g. tumor cell or APC, e.g. dendritic cell).

Pharmaceutical compositions comprising engineered cells and the methods described herein can be used in adoptive cell transfer applications. In some embodiments, cell compositions comprising engineered cells can be used in associated methods to, for example, modulate immunological activity in an immunotherapy approach to the treatment of, for example, a mammalian cancer or, in other embodiments the treatment of autoimmune disorders. The methods employed generally comprise a method of contacting a TIP of the present invention with a mammalian cell under conditions that are permissive to specific binding of the affinity modified IgSF domain and modulation of the immunological activity of the mammalian cell. In some embodiments, immune cells (such as tumor infiltrating lymphocytes (TILs), T-cells (including CD8+ or CD4+ T-cells), or APCs) are engineered to express as a membrane protein and/or as a soluble variant ICOSL polypeptide, immunomodulatory protein, or conjugate as described herein. The engineered cells can then contact a mammalian cell, such as an APC, a second lymphocyte or tumor cell in which modulation of immunological activity is desired under conditions that are permissive of specific binding of the affinity modified IgSF domain to a counter-structure on the mammalian cell such that immunological activity can be modulated in the mammalian cell. Cells can be contacted in vivo or ex vivo.

In some embodiments, the engineered cells are autologous cells. In other embodiments, the cells are allogeneic. In some embodiments, the cells are autologous engineered cells reinfused into the mammal from which it was isolated. In some embodiments, the cells are allogenic engineered cells infused into the mammal. In some embodiments, the cells are harvested from a patient's blood or tumor, engineered to express a polypeptide (such as the variant ICOSL polypeptide, immunomodulatory protein, or conjugate as described herein), expanded in an in vitro culture system (for example, by stimulating the cells), and reinfused into the patient to mediate tumor destruction. In some embodiments, the methods are conducted by adoptive cell transfer wherein cells expressing the TIP (e.g., a T-cell) are infused back into the patient. In some embodiments, the therapeutic compositions and methods of the invention are used in the treatment of a mammalian patient of cancers such as lymphoma, lymphoid leukemia, myeloid leukemia, cervical cancer, neuroblastoma, or multiple myeloma.

In some embodiments, the pharmaceutical composition can be used to inhibit growth of mammalian cancer cells (such as human cancer cells). A method of treating cancer can include administering an effective amount of any of the pharmaceutical compositions described herein to a subject with cancer. The effective amount of the pharmaceutical composition can be administered to inhibit, halt, or reverse progression of cancers.

The cancers that can be treated by the pharmaceutical compositions and the treatment methods described herein include, but are not limited to, melanoma, bladder cancer, hematological malignancies (leukemia, lymphoma, myeloma), liver cancer, brain cancer, renal cancer, breast cancer, pancreatic cancer (adenocarcinoma), colorectal cancer, lung cancer (small cell lung cancer and non-small-cell lung cancer), spleen cancer, cancer of the thymus or blood cells (i.e., leukemia), prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer. In some embodiments, the cancer is Ewing's sarcoma. In some embodiments, the cancer is selected from melanoma, lung cancer, bladder cancer, and a hematological malignancy. In some embodiments, the cancer is a lymphoma, lymphoid leukemia, myeloid leukemia, cervical cancer, neuroblastoma, or multiple myeloma.

Human cancer cells can be treated in vivo, or ex vivo. In ex vivo treatment of a human patient, tissue or fluids containing cancer cells are treated outside the body and then the tissue or fluids are reintroduced back into the patient. In some embodiments, the cancer is treated in a human patient in vivo by administration of the therapeutic composition into the patient.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy.

In some embodiments, the pharmaceutical composition is administered as a monotherapy (i.e., as a single agent) or as a combination therapy (i.e., in combination with one or more additional anticancer agents, such as a chemotherapeutic drug, a cancer vaccine, or an immune checkpoint inhibitor. In some embodiments, the pharmaceutical composition can also be administered with radiation therapy. In some aspects, the immune checkpoint inhibitor blocks PD-1 interactions with PD-L1 and/or PD-L2. In some cases, the immune checkpoint inhibitor is an antibody or antigen binding fragment thereof that specifically binds PD-1, PD-L1 or PD-L2. In some cases, the immune checkpoint inhibitor is an anti-PD-1 antibody, such as nivolumab or pembrolizumab or an antigen binding fragment thereof. In some cases, the immune checkpoint inhibitor blocks or is an antagonist of CTLA-4, such as is an anti-CTLA-4 antibody or antigen binding fragment thereof. In some aspects of the present disclosure, the immune checkpoint inhibitor is tremelimumab or ipilimumab.

In some embodiments, the pharmaceutical composition suppresses an immune response, which can be useful in the treatment of inflammatory or autoimmune disorders, or organ transplantation. In some embodiments, the pharmaceutical composition contains a variant ICOSL polypeptide in a format that exhibits antagonist activity of its cognate binding partner CD28 or ICOS and/or that blocks or inhibits costimulatory signaling via CD28 or ICOS. Exemplary formats of an ICOSL polypeptide for use in connection with such therapeutic applications include, for example, a variant ICOSL polypeptide that is soluble (e.g. variant ICOSL-Fc fusion protein), an immunomodulatory protein or "stack" of a variant ICOSL polypeptide and another IgSF domain, including soluble forms thereof that are Fc fusions, an engineered cell expressing a secretable immunomodulatory protein, or an infectious agent comprising a nucleic acid molecule encoding a secretable immunomodulatory protein, such as for expression and secretion of the secretable immunomodulatory protein in an infected cell (e.g. tumor cell or APC, e.g. dendritic cell).

In some embodiments, the inflammatory or autoimmune disorder is antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

In some embodiments, the inflammatory and autoimmune disorders that can be treated by the pharmaceutical composition described herein is Addison's Disease, allergies, alopecia areata, Alzheimer's, antineutrophil cytoplasmic antibodies (ANCA)-associated vasculitis, ankylosing spondylitis, antiphospholipid syndrome (Hughes Syndrome), asthma, atherosclerosis, rheumatoid arthritis, autoimmune hemolytic anemia, autoimmune hepatitis, autoimmune inner ear disease, autoimmune lymphoproliferative syndrome, autoimmune myocarditis, autoimmune oophoritis, autoimmune orchitis, azoospermia, Behcet's Disease, Berger's Disease, bullous pemphigoid, cardiomyopathy, cardiovascular disease, celiac Sprue/coeliac disease, chronic fatigue immune dysfunction syndrome (CFIDS), chronic idiopathic polyneuritis, chronic inflammatory demyelinating, polyradicalneuropathy (CIDP), chronic relapsing polyneuropathy (Guillain-Barré syndrome), Churg-Strauss Syndrome (CSS), cicatricial pemphigoid, cold agglutinin disease (CAD), COPD (chronic obstructive pulmonary disease), CREST syndrome, Crohn's disease, dermatitis, herpetiformis, dermatomyositis, diabetes, discoid lupus, eczema, epidermolysis bullosa acquisita, essential mixed cryoglobulinemia, Evan's Syndrome, exophthalmos, fibromyalgia, Goodpasture's Syndrome, Graves' Disease, Hashimoto's thyroiditis, idiopathic pulmonary fibrosis, idiopathic thrombocytopenia purpura (ITP), IgA nephropathy, immunoproliferative disease or disorder, inflammatory bowel disease (IBD), interstitial lung disease, juvenile arthritis, juvenile idiopathic arthritis (JIA), Kawasaki's Disease, Lambert-Eaton Myasthenic Syndrome, lichen planus, lupus nephritis, lymphocytic hypophysitis, Ménière's Disease, Miller Fish Syndrome/acute disseminated encephalomyeloradiculopathy, mixed connective tissue disease, multiple sclerosis (MS), muscular rheumatism, myalgic encephalomyelitis (ME), myasthenia gravis, ocular inflammation, *Pemphigus foliaceus, Pemphigus vulgaris*, pernicious anaemia, polyarteritis nodosa, polychondritis, polyglandular syndromes (Whitaker's syndrome), polymyalgia rheumatica, polymyositis, primary agammaglobulinemia, primary biliary cirrhosis/autoimmune cholangiopathy, psoriasis, psoriatic arthritis, Raynaud's Phenomenon, Reiter's Syndrome/reactive arthritis, restenosis, rheumatic fever, rheumatic disease, sarcoidosis, Schmidt's syndrome, scleroderma, Sjörgen's Syndrome, stiff-man syndrome, systemic lupus erythematosus (SLE), systemic scleroderma, Takayasu arteritis, temporal arteritis/giant cell arteritis, thyroiditis, Type 1 diabetes, ulcerative colitis, uveitis, vasculitis, vitiligo, interstitial bowel disease or Wegener's Granulomatosis. In some embodiments, the inflammatory or autoimmune disorder is selected from interstitial bowel disease, transplant, Crohn's disease, ulcerative colitis, multiple sclerosis, asthma, rheumatoid arthritis, and psoriasis.

In some embodiments, the inflammatory or autoimmune disorder is a chronic autoimmune disease. In some embodiments, the inflammatory or autoimmune disorder is Sjogren's Syndrome (pSS) or Systemic Lupus Erythematosus (SLE). In some embodiments, the inflammatory or autoimmune disorder is an inflammatory bowel disease (IBD). In some examples, the inflammatory or autoimmune disorder is Crohn's Disease. In some embodiments, the inflammatory or autoimmune disorder is an IBD-related disease or disorder, e.g. interstitial lung disease (ILD). In some embodiments, the inflammatory or autoimmune disorder is psoriatic arthritis or rheumatoid arthritis. In some embodiments, the pharmaceutical composition is administered to modulate an autoimmune condition. For example, suppressing an immune response can be beneficial in methods for inhibiting rejection of a tissue, cell, or organ transplant from a donor by a recipient. Accordingly, in some embodiments, the pharmaceutical compositions described herein are used to limit or prevent graft-related or transplant related diseases or disorders, such as graft versus host disease (GvHD). In some embodiments, the pharmaceutical compositions are used to suppress autoimmune rejection of transplanted or grafted bone marrow, organs, skin, muscle, neurons, islets, or parenchymal cells.

In some embodiments, a pharmaceutical composition provided herein, such as a variant ICOSL IgSF (e.g. IgV) Fc fusion protein provided herein, is used to treat psoriatic arthritis (PsA). In some cases, the PsA affects one or more joints, such as fingers, toes, arms or legs, including elbows, wrists, hands and feet, or sacroiliac joint. In some cases, the PsA is mild and/or affects four or less joints. In some cases the PsA is moderate and/or affects four or more joints. In some cases, a subject with PsA may exhibit pain, stiffness or inflammation in the spine or neck, or in the one more joints.

In some embodiments, a pharmaceutical composition provided herein, such as a variant ICOSL IgSF (e.g. IgV) Fc fusion protein provided herein, is used to treat rheumatoid arthritis (RA). In some cases, RA affects joints, lining of joints, and/or non-joint structures in the body (e.g., skin, eyes, lungs, heart, kidneys, salivary glands, nerve tissue, bone marrow or blood vessels). In some embodiments, RA or RA symptoms are chronic.

In some embodiments, a pharmaceutical composition provided herein, such as a variant ICOSL IgSF (e.g. IgV) Fc fusion protein provided herein, is used to treat GVHD. In some embodiments, the GVHD is acute GVHD (aGVHD). In some cases, aGVHD occurs after allogeneic hematopoietic stem cell transplant (HSCT) and/or a reaction of donor immune cells against host tissues. In some case, the aGVHD manifests in the skin, liver or gastrointestinal tract.

In some embodiments, a pharmaceutical composition provided herein, such as a variant ICOSL IgSF (e.g. IgV) Fc fusion protein provided herein, is used to treat an autoimmune condition associated with an organ transplant. In some cases, treating the autoimmune condition associated with an organ transplant may prolong the survival of the host and transplanted organ. In some embodiments, treating the autoimmune condition associated with an organ transplant includes prophylaxis of or inhibiting or preventing transplant rejections by a subject that is the recipient of the organ transplant.

In some embodiments, a pharmaceutical composition provided herein, such as a variant ICOSL IgSF (e.g. IgV) Fc fusion protein provided herein, is used to treat an inflammatory bowel disease (IBD). In some embodiments, a pharmaceutical composition provided herein, such as a variant ICOSL IgSF (e.g. IgV) Fc fusion protein provided herein, is used to treat Crohn's disease. In some embodiments, the Crohn's disease can include a subtype from Crohn's colitis, Crohn's enteritis, Crohn's ileitis or Crohn's enterocolitis.

In some embodiments, a pharmaceutical composition provided herein, such as a variant ICOSL IgSF (e.g. IgV) Fc fusion protein provided herein, is used to treat systemic lupus erythematosus (SLE). In some embodiments, a pharmaceutical composition provided herein, such as a variant ICOSL IgSF (e.g. IgV) Fc fusion protein provided herein, is used to treat Sjogren's Syndrome.

IX. EXEMPLARY EMBODIMENTS

Among the provided embodiments are:

1. A variant ICOS Ligand (ICOSL) polypeptide, comprising one or more amino acid modifications in an immunoglobulin superfamily (IgSF) domain of an ICOSL reference polypeptide, wherein the ICOSL reference polypeptide is a truncated extracellular domain comprising a contiguous sequence of amino acids comprising amino acids 1-112 and a C-terminal truncation of at least 25 amino acids with reference to the ICOSL extracellular domain sequence set forth in SEQ ID NO: 32.

2. The variant ICOSL polypeptide of embodiment 1, wherein the variant ICOSL polypeptide exhibits altered binding to the ectodomain(s) of ICOS or CD28 compared to the binding of the ICOSL reference polypeptide for the same ectodomain(s).

3. The variant ICOSL polypeptide of embodiment 1 or embodiment 2, wherein the variant ICOSL polypeptide exhibits increased binding to the ectodomain(s) of ICOS or CD28 compared to the binding of the ICOSL reference polypeptide for the same ectodomain(s).

4. The variant ICOSL polypeptide of any of embodiments 1-3, wherein the C-terminal truncation is of at least 30, at least 40, at least 50, at least 60, at least 70, at least 80, at least 90, at least 100, at least 125 amino acid residues.

5. The variant ICOSL polypeptide of any of embodiments 1-4, wherein the ICOSL reference polypeptide is altered in or lacks a protease cleavage site set forth as amino acids 204-209 of SEQ ID NO: 32.

6. The variant ICOSL polypeptide of any of embodiments 1-5, wherein the ICOSL reference polypeptide comprises the sequence of amino acids set forth in SEQ ID NO: 545.

7. The variant ICOSL polypeptide of any of embodiments 1-5, wherein the ICOSL reference polypeptide consists of the sequence of amino acids set forth in SEQ ID NO: 545.

8. A variant ICOSL Ligand (ICOSL) polypeptide, comprising one or more amino acid modifications in an ICOSL reference polypeptide, wherein the ICOSL reference polypeptide consists of the sequence of amino acids set forth in SEQ ID NO: 545.

9. A variant ICOS Ligand (ICOSL) polypeptide, comprising one or more amino acid modifications in an immunoglobulin superfamily (IgSF) domain of an ICOSL reference polypeptide, wherein the ICOSL reference polypeptide is altered in one or more amino acids corresponding to amino acids 204-209 with reference to SEQ ID NO: 32.

10. The variant ICOSL polypeptide of embodiment 8 or embodiment 9, wherein the variant ICOSL polypeptide exhibits altered binding to one or more of its binding partner(s) compared to the binding of the ICOSL reference polypeptide for the one or more binding partner(s).

11. The variant ICOSL polypeptide of embodiment 8 or embodiment 9, wherein the variant ICOSL polypeptide exhibits increased binding to one or more of its binding partner(s) compared to the binding of the ICOSL reference polypeptide for the one or more binding partner(s).

12. The variant ICOSL polypeptide of any of embodiments 9-11, wherein the alteration comprises a deletion of one or more contiguous amino acids corresponding to amino acids 204-209 with reference to SEQ ID NO: 32.

13. The variant ICOSL polypeptide of any of embodiments 1-6 and 9-12, wherein the ICOSL reference polypeptide comprises the sequence of amino acids set forth in any of SEQ ID NOS: 600-605.

14. The variant ICOSL polypeptide of any of embodiments 1-6 and 9-12, wherein the ICOSL reference polypeptide consists of the sequence of amino acids set forth in any of SEQ ID NOS: 600-605.

15. The variant ICOSL polypeptide of any of embodiments 1-6 and 9-14, wherein the alteration comprises at least one amino acid substitution at one or both of position 207 and 208 corresponding to positions set forth in SEQ ID NO: 32.

16. The variant ICOSL polypeptide of embodiment 15, wherein the at least one amino acid substitution is N207A, N207G or L208G, or a conservative amino acid substitution thereof.

17. The variant ICOSL polypeptide of any of embodiments 9-16, wherein the reference ICOSL polypeptide comprises the sequence of amino acids set forth in any of SEQ ID NOS: 623-628.

18. The variant ICOSL polypeptide of any of embodiments 9-17, wherein the reference ICOSL polypeptide consists of the sequence of amino acids set forth in any of SEQ ID NOS: 623-628.

19. The variant ICOSL polypeptide of any of embodiments 5-7 and 9-18, wherein the variant ICOSL polypeptide exhibits reduced proteolytic cleavage when expressed from a cell, optionally compared to a full-length extracellular domain of the variant ICOSL polypeptide when expressed from the same cell.

20. The variant ICOSL polypeptide of embodiment 19, wherein the cell is a mammalian cell.

21. The variant ICOSL polypeptide of embodiment 19 or embodiment 20, wherein the cell is a Chinese Hamster Ovary (CHO) cell line or a derivative thereof.

22. The variant ICOSL polypeptide of any of embodiments 1-21, wherein the amino acid modification is an amino acid substitution, insertion or deletion.

23. The variant of any of embodiments 1-22, wherein the one or more amino acid modifications are in a position corresponding to position(s) selected from 10, 11, 13, 16, 18, 20, 25, 26, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 137, 138, 139, 140, 142, 143, 144, 146, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32.

24. The variant of any of embodiments 1-23, wherein the one or more amino acid modifications are selected from M10V, M10I, V11E, S13G, E16V, S18R, A20T, A20V, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110A, V110D, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193A, V193M, N194D, C198R, N201S, L203F, L203P, N207Q, L208P, V210A, S212G, D217G, D217V, I218N, I218T, E220G, R221G, R221I, R221K, I224V, T225A, T225S, N227K, or a conservative amino acid substitution thereof.

25. The variant ICOSL polypeptide of any of embodiments 1-24, wherein the one or more amino acid modifications are in a position corresponding to position(s) 52, 57 or 100.

26. The variant ICOSL polypeptide of any of embodiments 1-25, wherein the one or more amino acid modifications are selected from N52A, N52C, N52D, N52G, N52H, N52K, N52L, N52M, N52Q, N52R, N52S, N52T, N52V, N52Y, N52K, S54A, S54P, N57A, N57D, N57E, N57F, N57H, N57K, N57L, N57M, N57P, N57Q, N57S, N57T, N57V, N57Y, N57W, Q100A, Q100D, Q100G, Q100K, Q100L, Q100M, Q100N, Q100P, Q100R, Q100S, Q100T or Q100V.

27. The variant ICOSL polypeptide of any of embodiments 1-26, wherein the one or more amino acid modifications are selected from among N52Y/N57Y/F138L/L203P, N52H/N57Y/Q100P, N52S/Y146C/Y152C, N52H/C198R, N52H/C140D/T225A, N52H/C198R/T225A, N52H/K92R, N52H/S99G, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, N52D/S54P, N52K/L208P, N52S/Y152H, N52D/V151A, N52H/I143T, N52S/L80P, N52S/R75Q/L203P, N52S/D158G, N52D/Q133H, N52S/N57Y/H94D/L96F/L98F/Q100R, N52S/N57Y/H94D/L96F/L98F/Q100R/G103E/F120S, N52S/G103E, N52H/F78L/Q100R, N52H/N57Y/Q100R/V110D, N52H/N57Y/R75Q/Q100R/V110D, N52H/N57Y/Q100R, N52H/N57Y/L74Q/Q100R/V110D, N52H/Q100R, N52H/S121G, A20V/N52H/N57Y/Q100R/S109G, N52H/N57Y/R61S/Q100R/V110D/L173S, N52H/N57Y/Q100R/V122A, N52H/N57Y/Q100R/F172S, N52H/N57Y, N52S/F120S, N52S/V97A, N52S/G72R, N52S/A71T/A117T, N52S/E220G, Y47H/N52S/V107A/F120S, N52H/N57Y/Q100R/V110D/S132F/M175T, E16V/N52H/N57Y/Q100R/V110D/H115R/Y152C/K156M/C198R, Q37R/N52H/N57Y/Q100R/V110N/S142F/C198R/D217V/R221G, N52H/N57Y/Q100R/V110D/C198R, N52H/N57Y/Q100R/V110D/V116A/L161M/F172S/S192G/C198R, F27S/N52H/N57Y/V110N, N52S/H94E/L96I/S109N/L166Q, S18R/N52S/F93L/I143V/R221G, A20T/N52D/Y146C/Q164L, V11E/N30D/N52H/N57Y/H94E/L96I/L98F/N194D/

V210A/I218T, N52S/H94E/L96I/V122M, N52H/N57/ H94E/L96I/F120I/S126T/W153R/I218N, M10V/S18R/ N30D/N52S/S126R/T139S/L203F, S25G/N30D/N52S/ F120S/N227K, N30D/N52S/L67P/Q100K/D217G/R221K/ T225S, N52H/N57Y/Q100R/V110D/A117T/T190S/ C198R, N52H/N57Y/Q100R/V110D/F172S/C198R, S25G/ F27C/N52H/N57Y/Q100R/V110D/E135K/L173S/C198R, N52H/N57Y/V110A/C198R/R221I, M10I/S13G/N52H/ N57Y/D77G/V110A/H129P/I143V/F172S/V193M, C198R, N52H/N57Y/R61C/Y62F/Q100R/V110N/F120S/ C198R, N52H/N57Y/Q100R/V110D/H115R/C198R, N52H/N57Y/Q100R/V110D/N144D/F172S/C198R, N52S/ H94E/L98F/Q100R, N52S/E90A, N30D/K42E/N52S, N52S/F120S/I143V/I224V, N52H/N57Y/Q100R/V110D/ C198R/S212G, N52H/N57Y/Q100R/C198R, N52S/N194D, N52H/N57Y/Q100R/L102R/V110D/H115R/C198R, N52H/ N57Y/Q100R/V110D/C198R/S212G, N52H/N57Y/ Q100R/C198R, N52S/N194D, N52H/N57Y/Q100R/ L102R/V110D/H115R/C198R, N52S/S54P, N52S/ N57D, N52H/C140del/T225A, N52H/F78L/Q100R/C198R, N52H/N57Y/R75Q/Q100P/V110D, N52H/N57Y/L74Q/ V110D/S192G, N52H/S121G/C198R, N52S/F120S/ N227K, N52S/A71T/A117T/T190A/C198R, T43A/N52H/ N57Y/L74Q/D89G/V110D/F172S, N52H/N57Y/Q100R/ V110D/S132F/M175T, N52D, N52H/N57Y/Q100R/V107I/ V110D/I154F/C198R/R221G, N52Q/N207Q, N168Q/N207Q, N52Q/N168Q, N52Q/N84Q, N52Q/N119Q, N52Q/N84Q/N168Q, N52Q/N84Q/N207Q, N52Q/N119Q/N155Q, N52H/N84Q/N119Q, N52H/N84Q, N52H/N84Q/N168Q/N207Q, N52Q/N84Q/N155Q/N168Q, N52Q/N84Q/N119Q/N168Q, N52Q/N84Q/N119Q/N207Q, N52Q/N84Q/N119Q/N155Q, N52Q/N84Q/N119Q/N155Q/N207Q, N52Y/F138L/L203P, N57Y/Q100R/C198R, N57Y/F138L/L203P, Q100R/F138L, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R/H115R/F172S/C198R, N52H/V122A/F172S/C198R, N52H/N57Y/Q100R/H115R/F172S/N194D, N52H/N57Y/H115R/F172S/C198R, N52H/N57Y/Q100R/H115R/C198R, N52H/N57Y/H115R, N52H/N57Y/Q100R/H115R, N52H/N57Y/Q100R/H115R/F172S/I224V, N52H/N57Y/Q100R/H115R/F172S, N52H/N57Y/Q100R/F172S, N52H/Q100R/H115R/I143T/F172S, N52H/N57Y/Q100P/H115R/F172S, N52Y/N57Y/Q100P/F172S, E16V/N52H/N57Y/Q100R/V110D/H115R/C198R, E16V/N52H/N57Y/Q100R/V110D/H115R/Y152C/K156M/F172S/C198R, N52S/E90A/H115R, N30D/K42E N52S/H115R, N30D/K42E/N52S/H115R/C198R/R221I, N30D/K42E/N52S/H115R/C198R, N30D/K42E/N52S/H115R/F172S/N194D, N52S/H115R/F120S/I143V/C198R, N52S/H115R/F172S/C198R, N52H/N57Y/Q100P/C198R, N52H/N57Y/Q100P H I15R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/F172S/C198R, N52H/Q100R/H115R/F172S/C198R, N52H/N57Y/Q100R/F172S/C198R, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57H/Q100K, N52R/N57L/Q100S, N52R/N57W/Q100K, N52R/N57W, N52R/N57Y/Q100R, N52C/N57E/Q100S, N52G/N57P/Q100D, N52G/N57V/Q100G, N52G/N57V, N52L/N57V, N52P/N57P, N52P/N57S/Q100G, N52S/N57L/Q100G, N52T/N57K/Q100P, N52V/N57T/Q100L, N57Q/Q100P, or R26S/N52H/N57Y/V110D/T137A/C198R.

28. The variant ICOSL polypeptide of any of embodiments 1-24, wherein the one or more amino acid modifications are selected from among F120S/Y152H/N201S, E111del, Y33del, N168Q/N207Q, N84Q/N207Q, N155Q/N207Q, N119Q/N168Q, N119Q/N207Q, N119Q/N155Q, N84Q/N119Q, N84Q/N155Q/N168Q, N84Q/N168Q/N207Q, N84Q/N155H/N207Q, N155Q/N168Q/N207Q, N119Q N155Q/N168Q, N119Q/N168Q/N207Q, N84Q/N119Q/N207Q, N119Q/N155H/N207Q, N84Q/N119Q/N155Q, N84Q/N119Q/N155Q/N168Q, N84Q/N155Q/N168Q/N207Q, N84Q/N119Q/N155Q/N207Q, N84Q/N119Q/N155Q/N168Q/N207Q or F138L/L203P.

29. The variant ICOSL polypeptide of any of embodiments 1-28, wherein the one or more amino acid modifications are selected from C198R, D158G, E16V, E90A, F120S, F138L, F172S, H115R, H115X, I143T, I143V, I224V, K156M, K42E, K92R, L102R, L203P, L208P, N194D, N30D, N52A, N52D, N52G, N52H, N52K, N52L, N52M, N52Q, N52R, N52S, N52T, N52Y, N57F, N57H, N57K, N57L, N57M, N57P, N57S, N57V, N57W, N57Y, Q100A, Q100D, Q100E, Q100K, Q100M, Q100P, Q100P, Q100R, Q100S, Q100T, Q133H, R221I, R75Q, S54A, S54P, T113E, T225A, V110D, V122A, Y146C, or Y152C; or A117T, A20V, A71T, A91G, A91G, AE88D, C140del, C198R, D158G, D77G, D90K, E117G, E135K, E16V, E81A, E88D, E90A, F120I, F120S, F138L, F172S, F27C, F92Y, G72R, H115R, H115X, H129P, H94E, I118V, I127T, I143T, I143V, I154F, I218N, I218T, I224V, K156M, K169E, K36G, K42E, K89R, K92R, K93R, L102R, L161P, L166Q, L173S, L203F, L203P, L208P, L209P, L40M, L70Q, L70R, L74Q, L80P, L96I, L98F, M10I, M10V, N115Q, N119Q, N122S, N144D, N155X, N168Q, N168X, N178S, N194D, N207Q, N207X, N227K, N25S, N30D, N52A, N52D, N52G, N52H, N52K, N52L, N52M, N52Q, N52R, N52S, N52T, N52V, N52Y, N57A, N57F, N57H, N57L, N57M, N57S, N57V, N57W, N57Y, N63S, N84Q, Q100A, Q100E, Q100G, Q100K, Q100M, Q100N, Q100P, Q100R, Q100S, Q100T, Q100V, Q133H, R221G, R221I, S109G, S109N, S114T, S121G, S126R, S126T, S130G, S132F, S13G, S18R, S192G, S212G, S25G, S54A, S54P, S99G, T113E, T120S, T130A, T139S, T190A, T199S, T225A, T41I, V107I, V110A, V110D, V11E, V122A, V122M, V193M, V210A, W153R, Y146C, Y152C, or Y152H.

30. The variant ICOSL polypeptide of any of embodiments 1-29, wherein the one or more amino acid modifications are selected from among N52S, N52H, N52D, N52H/N57Y/Q100P, N52S/Y146C/Y152C, N52H/C198R, N52H/C198R/T225A, N52H/K92R, N57Y, N52S/C198R, N52S/T113E, S54A, N52D/S54P, N52K/L208P, N52H/I143T, N52S/R75Q/L203P, N52S/D158G, N52D/Q133H, N52H/N57Y/Q100R/V122A, N52H/N57Y/Q100R/F172S, N52H/N57Y/Q100R, N52S/N194D, N52H/N57Y/Q100R/L102R/V110D/H115R/C198R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/ C198R, N52H/Q100R/C198R, N52H/Q100R/H115X/ F172S/C198R, N52H/Q100R/H115R/F172S/C198R, N52H/N57Y/Q100R/H115R/F172S/C198R, N52H/N57Y/ Q100R/H115R/F172S, N52H/N57Y/Q100R/H115R/F172S/ C198R, Q100R, N52Y/F138L/L203P, N57Y/Q100R/ C198R, N57Y/F138L/L203P, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/ Q100R/H115R/F172S, N52H/N57Y/Q100R/H115R/ C198R, N52H/N57Y/Q100R/F172S/C198R, N52H/N57Y/ Q100R/H115R/F172S/C198R, N52H/N57Y/Q100R/ H115R/I143V/F172S/C198R, N52H/N57Y/Q100R/L102R, H115R/F172S/C198R, N52H/N57Y/Q100R/H115R F172S/ N194D, N52H/N57Y/H115R/F172S/C198R, N52H/N57Y/ Q100R/H115R/C198R, N52H/N57Y/H115R, N52H/ Q100R/H115R/I143T F172S, N52H/N57Y/Q100P/H115R/ F172S, E16V/N52H/N57Y/Q100R/V110D/H115R/C198R, N52S/E90A/H115R, N30D/K42E/N52S/H115R/C198R/ R221I, N30D/K42E/N52S/H115R/C198R, N30D/K42E/ N52S/H115R/F172S/N194D, N30D/K42E/N52S/H115R, N52S/E90A/H115R, N30D/K42E/N52S/H115R, N52A/ N57H/Q100S, N52A/N57Y/Q100A, N52D/Q100S, N52G/ Q100A, N52M/N57H/Q100S, N52M/N57W/Q100P, N52Q/ N57S/Q100A, N52R/N57L/Q100A, N52S/N57H/Q100E, N52S/N57L/Q100S, N52S/N57M/Q100S, N52S/N57Y/Q100M, N52T/N57H/Q100S, N52R/N57F/Q100P, N52R/N57F/Q100T, N52R/N57W/Q100K, N52R/N57W, N52G/N57P/Q100D, N52G/N57V/Q100G, N52G/N57V, N52L/N57V, N52S/N57L/Q100G or N52T/N57K/Q100P; or

N52S, N52H, N52D, N52Y/N57Y/F138L/L203P, N52H/N57Y/Q100P, N52S/Y146C/Y152C, N52H/C198R, N52H/C140del/T225A, N52H/C198R/T225A, N52H/K92R, N52H/S99G, N57Y, N57Y/Q100P, N52S/S130G/Y152C, N52S/Y152C, N52S/C198R, N52Y/N57Y/Y152C, N52Y/N57Y/H129P/C198R, N52H/L161P/C198R, N52S/T113E, S54A, N52D/S54P, N52K/L208P, N52S/Y152H, N52H/I143T, N52S/L80P, N52S/D158G, N52D/Q133H, L70Q/A91G/N144D, L70Q/A91G/E117G/I118V/T120S/T130A, L70R/A91G/I118V/T120S/T130A/T199S, L70Q/E81A/A91G/I118V/T120S/I127T/T130A, N63S/L70Q/A91G/S114T/I118V/T120S/T130A, T41I/A91G, E88D/K89R/D90K/A91G/F92Y/K93R/N122S/N178S, E88D/K89R/D90K/A91G/F92Y/K93R, AE88D/K89R/D90K/A91G/F92Y/K93R, K36G/L40M, N52H/N57Y/Q100R/V122A, N52H/N57Y/Q100R/F172S, N52H/N57Y/Q100R, N52S/F120S/N227K, N52S/N194D, N52S/F120S, N52S/G72R, N52S/A71T/A117T/T190A/C198R, N52H/N57Y/Q100R/V107I/V110D/S132F/I154F/C198R/R221G, E16V/N52H/N57Y/Q100R/V110D/H115R/Y152C/K156M/C198R, N52H/N57Y/Q100R/V110D/C198R, V11E/N30D/N52H/N57Y/H94E/L96I/L98F/N194D/V210A/I218T, N52S/H94E/L96I/V122M, N52H/N57Y/H94E/L96I/F120I/S126T/W153R/I218N, M10V/S18R/N30D/N52S/S126R/T139S/L203F, S25G/N30D/N52S/F120S/N227K, N52H/N57Y/Q100R/V110D/F172S/C198R, S25G/F27C/N52H/N57Y/Q100R/V110D/E135K/L173S/C198R, N52H/N57Y/V110A/C198R/R221I, M10I/S13G/N52H/N57Y/D77G/V110A/H129P/I143V/F172S/V193M, C198R, N52H/N57Y/Q100R/L102R/V110D/H115R/C198R, N52H/N57Y/Q100R/V110D/N144D/F172S/C198R, N52S/H94E/L98F/Q100R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/H115X/F172S/C198R, N52H/Q100R/H115R/F172S/C198R, N52H/N57Y/Q100R/F172S/C198R, N52H/N57Y/Q100R/H115R/F172S/C198R, N52H/N57Y/Q100R/H115R/F172S, N52H/N57Y/Q100R/H115R/F172S/C198R, N52S/H94E/L96I/S109N/L166Q/N52H/N57Y/Q100R/C198R, N52H/N57Y/L74Q/V110D/S192G, N52H/Q100R, N52H/S121G/C198R, A20V/N52H/N57Y/Q100R/S109G, N52H/N57Y/Q100P/C198R, N52H/N57Y/Q100R/V110D/C198R/S212G, L70Q/A91G/I118A/T120S/T130A/K169E, Q100R, N52Y/F138L/L203P, N57Y/Q100R/C198R, N57Y/F138L/L203P, N52H, N57Y, N57Y/Q100P, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T F172S, N52H/N57Y/Q100P/H115R/F172S, E16V/N52H/N57Y/Q100R/V110D/H115R/C198R, N30D/K42E/N52S/H115R/C198R R221I, N52S/E90A/H115R, N30D/K42E/N52S/H115R, N52S/H115R/F172S/C198R, N119Q, N207Q, N52Q/N207X, N168X/N207X, N52Q/N168Q, N84Q/N207Q, N119Q N155X, N52Q/N119Q, N52Q/N84Q/N207Q, N119Q/N155Q/N168Q, N52H/N84Q/N119Q, N52Q/N84Q/N155X/N168X, N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57L/Q100S, N52R/N57W/Q100K, N52R/N57W, N52G/N57V, N52L/N57V, N52S/N57L/Q100G, or N52T/N57K/Q100P.

31. The variant ICOSL polypeptide of any of embodiments 1-30, wherein the variant ICOSL polypeptide exhibits increased binding to the ectodomain of ICOS or CD28 compared to the binding of the reference ICOSL polypeptide to the same ectodomain.

32. The variant ICOSL polypeptide of any of embodiments 1-31, wherein the one or more amino acid modifications are selected from C198R, D158G, E16V, E90A, F120S, F138L, F172S, H115R, I143V, I224V, K156M, K42E, K92R, L102R, L203P, L208P, N194D, N30D, N52A, N52D, N52G, N52H, N52K, N52L, N52M, N52Q, N52R, N52S, N52T, N52Y, N57F, N57H, N57L, N57M, N57S, N57V, N57W, N57Y, Q100A, Q100E, Q100G, Q100K, Q100M, Q100P, Q100R, Q100S, Q133H, S212G, S54A, S54P, T113E, V110D, V122A, Y146C, Y152C, or T225A.

33. The variant ICOSL polypeptide of any of embodiments 1-33, wherein the one or more amino acid modifications are selected from among N52A/N57Y/Q100A, N52D/Q100S, N52G/Q100A, N52M/N57H/Q100S, N52M/N57W/Q100P, N52Q/N57S/Q100A, N52R/N57L/Q100A, N52S/N57H/Q100E, N52S/N57L/Q100S, N52S/N57M/Q100S, N52S/N57Y/Q100M, N52T/N57H/Q100S, N52R/

N57F/Q100P, N52R/N57F/Q100T, N52R/N57W/Q100K, N52R/N57W, N52G/N57V, N52L/N57V, N52S/N57L/Q100G, N52T/N57K/Q100P, N52S, N52H, N52D, N52Y/N57Y/F138L/L203P, N52H/N57Y/Q100P, N52S/Y146C/Y152C, N52H/C198R, N52H/C198R/T225A, N52H/K92R, N57Y, N52S/C198R, N52S/T113E, S54A, N52D/S54P, N52K/L208P, N52H/I143T, N52S/D158G, N52D/Q133H, N52H/N57Y/Q100R/V110D/C198R/S212G, N52H/N57Y/Q100R/V122A, N52H/N57Y/Q100R/F172S, N52H/N57Y/Q100R, N52S/N194D, N52H/N57Y/Q100R/L102R/V110D/H115R/C198R, N52S/E90A, N52S/F120S/I143V/I224V, N52H/N57Y/Q100R/F172S/C198R, N52H/N57Y/Q100R/H115R/F172S/C198R, N52Y/N57Y/Q100P/F172S, E16V/N52H/N57Y/Q100R/V110D/H115R/Y152C/K156M/F172S/C198R, N52S/H115R/F120S/I143V/C198R, N52H/N57Y/Q100P/C198R, N52H/N57Y/Q100P/H115R/F172S/C198R, N52H/N57Y/Q100P/F172S/C198R, N52H/N57Y/Q100P/H115R, N52H/N57Y/Q100P/H115R/C198R, N52H/Q100R/C198R, N52H/Q100R/H115R/F172S, N52H/Q100R/H115X/F172S/C198R, N52H/Q100R/H115R/F172S/C198R, N52H/N57Y/Q100R/H115R/F172S/C198R, N52H/N57Y/Q100R/H115R/F172S, N52H/N57Y/Q100R/H115R/F172S/C198R, Q100R, N52Y/F138L/L203P, N57Y/Q100R/C198R, N57Y/F138L/L203P, N52H, N57Y, N57Y/Q100P, Q100R/F138L, N52H/N57Y/Q100R/H115R, N52H/N57Y/Q100R/F172S, N52H/N57Y/Q100R/H115R/F172S/I224V, N52H/N57Y/Q100R/H115R/F172S, N52H/N57Y/Q100R/H115R/C198R, N52H/N57Y/Q100R/F172S/C198R, N52H/N57Y/Q100R/H115R/F172S/C198R, N52H/N57Y/Q100R/H115R/I143V/F172S/C198R, N52H/N57Y/Q100R/L102R H115R/F172S/C198R, N52H/N57Y/Q100R/H115R F172S/N194D, N52H/N57Y/H115R/F172S/C198R, N52H/N57Y/Q100R/H115R/C198R, N52H/N57Y/H115R, N52H/Q100R/H115R/I143T/F172S, N52H/N57Y/Q100P/H115R/F172S, E16V/N52H/N57Y/Q100R/V110D/H115R/C198R, N52S/E90A/H115R, N52S/E90A/H115R, or N30D/K42E/N52S/H115R.

34. The variant ICOSL polypeptide of any of embodiments 1-33, wherein the variant ICOSL polypeptide exhibits increased binding to the ectodomain of ICOS and CD28 compared to the binding of the reference ICOSL polypeptide to the same ectodomains.

35. The variant ICOSL polypeptide of any of embodiments 1-34, wherein the variant ICOSL polypeptide comprises the sequence of amino acids set forth in any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910, or a sequence of amino acids that exhibits at least 90%, 91%%, 92%, 93%, 94%, 95%, 96%, 97%, 98%, or 99% sequence identity to any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910.

36. The variant ICOSL polypeptide of any of embodiments 1-34, wherein the variant ICOSL polypeptide consists of the sequence of amino acids set forth in any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, 910, or a sequence of amino acids that exhibits at least 90%, 91%%, 92%, 93%, 94%, 95%, 96%, 97%, 98%, or 99% sequence identity to any one of SEQ ID NOS: 546-599, 734-781, 783, 786, 788, 792, 796, 798, 800, 802, 804, 806, 808, 811, 813, 815, 817, 818, 820, 822, 824, 826, 827, 829, 831, 833, 834, 836, 838, 840-843, 845, 847, 848, 850-853, 855, 857, 907, or 910.

37. A variant ICOS Ligand (ICOSL) polypeptide, comprising an IgV domain or specific binding fragment thereof, an IgC domain or a specific binding fragment thereof, or both, wherein the variant ICOSL polypeptide comprises one or more amino acid modifications in an ICOSL reference polypeptide or a specific binding fragment thereof corresponding to amino acid modifications are selected from N52A, N52C, N52D, N52G, N52K, N52L, N52M, N52R, N52T, N52V, N57A, N57E, N57F, N57H, N57K, N57L, N57M, N57P, N57Q, N57S, N57T, N57V, N57W, Q100A, Q100D, Q100G, Q100L, Q100M, Q100N, Q100R, Q100S, Q100T or Q100V. with reference to SEQ ID NO:32.

38. The variant ICOSL polypeptide of embodiment 37, wherein the one or more amino acid modifications are selected from among N52A/N57F/Q100S, N52A/N57H/Q100S, N52A/N57Y/Q100A, N52D/N57A/Q100A, N52D/Q100S, N52G/Q100A, N52H/Q100A, N52M/N57H/Q100S, N52M/N57W/Q100P, N52Q/N57F, N52Q/N57S/Q100A, N52R/N57L/Q100A, N52R/N57Y/Q100P, N52R/N57Y/Q100S, N52S/N57A/Q100A, N52S/N57H/Q100E, N52S/N57L/Q100S, N52S/N57M/Q100S, N52S/N57Y/Q100S, N52S/N57Y/Q100M, N52S/N57Y/Q100V, N52T/N57H/Q100S, N52T/N57H/Q100A, N52T/N57Y/Q100A, N52V/N57L/Q100A, N52H/N57Y/Q100K, N52K/N57Y/Q100R, N52L/N57H/Q100R, N52R/N57F/Q100N, N52R/N57F/Q100P, N52R/N57F/Q100R, N52R/N57F/Q100T, N52R/N57H/Q100K, N52R/N57L/Q100S, N52R/N57W/Q100K, N52R/N57W, N52R/N57Y/Q100R, N52C/N57E/Q100S, N52G/N57P/Q100D, N52G/N57V/Q100G, N52G/N57V, N52L/N57V, N52P/N57P, N52P/N57S/Q100G, N52S/N57L/Q100G, N52T/N57K/Q100P, N52V/N57T/Q100L or N57Q/Q100P.

39. The variant ICOSL polypeptide of embodiment 37 or embodiment 38, wherein the ICOSL reference polypeptide is a mammalian ICOSL or a specific binding fragment thereof.

40. The variant ICOSL polypeptide of any of embodiments 37-39, wherein the ICOSL reference polypeptide is a human ICOSL or a specific binding fragment thereof.

41. The variant ICOSL polypeptide of any one of embodiments 37-40, wherein the ICOSL reference polypeptide comprises (i) the sequence of amino acids set forth in SEQ ID NO:32, (ii) a sequence of amino acids that has at least 95% sequence identity to SEQ ID NO:32; or (iii) a portion of (i) or (ii) comprising an IgV domain or IgC domain or specific binding fragments thereof or both.

42. The variant ICOSL polypeptide of any one of embodiments 37-41, wherein:
the specific binding fragment of the IgV domain or IgC domain has a length of at least 50, 60, 70, 80, 90, 100, 110 or more amino acids; or
the specific binding fragment of the IgV domain comprises a length that is at least 80% of the length of the IgV domain set for as amino acids 19-129 of SEQ ID NO:5 and/or the specific binding fragment of the IgC domain comprises a length that is at least 80% of the length of the IgC domain set forth as amino acids 141-227 of SEQ ID NO:5.

43. The variant ICOSL polypeptide of any of embodiments 37-42, wherein the variant ICOSL polypeptide comprises the IgV domain or a specific fragment thereof and the IgC domain or a specific fragment thereof.

44. The variant ICOSL polypeptide of any of embodiments 37-43, wherein the variant ICOSL polypeptide comprises the sequence of amino acids set forth in any one of SEQ ID NOS: 638-685, 905, 908, or a sequence of amino acids that exhibits at least 90%, 91%%, 92%, 93%, 94%, 95%, 96%, 97%, 98%, or 99% sequence identity to any one of SEQ ID NOS: 638-685, 905, 908.

45. The variant ICOSL polypeptide of any of embodiments 37-43, wherein the variant ICOSL polypeptide consists of the sequence of amino acids set forth in any one of SEQ ID NOS: 638-685, 905, 908, or a sequence of amino acids that exhibits at least 90%, 91%%, 92%, 93%, 94%, 95%, 96%, 97%, 98%, or 99% sequence identity to any one of SEQ ID NOS: 638-685, 905, 908.

46. The variant ICOSL polypeptide of any of embodiments 37-43, wherein the variant ICOSL polypeptide comprises the IgV domain or a specific binding fragment thereof.

47. The variant ICOSL polypeptide of any of embodiments 37-43 and 46, wherein the variant ICOSL polypeptide comprises the sequence of amino acids set forth in any one of SEQ ID NOS: 686-781, 907, 910, or a sequence of amino acids that exhibits at least 90%, 91%%, 92%, 93%, 94%, 95%, 96%, 97%, 98%, or 99% sequence identity to any one of SEQ ID NOS: 686-781, 907, 910.

48. The variant ICOSL polypeptide of any of embodiments 37-43 and 46, wherein the variant ICOSL polypeptide consists of the sequence of amino acids set forth in any one of SEQ ID NOS: 686-781, 907, 910, or a sequence of amino acids that exhibits at least 90%, 91%%, 92%, 93%, 94%, 95%, 96%, 97%, 98%, or 99% sequence identity to any one of SEQ ID NOS: 686-781, 907, 910.

49. The variant ICOSL polypeptide of any of embodiments 37-43 and 46-48, wherein the IgV domain or specific binding fragment thereof is the only ICOSL portion of the variant ICOSL polypeptide.

50. The variant ICOSL polypeptide of any of embodiments 37-42, wherein the IgC domain or specific binding fragment thereof is the only ICOSL portion of the variant ICOSL polypeptide.

51. The variant ICOSL polypeptide of any of embodiments 37-50, wherein the variant ICOSL polypeptide exhibits altered binding to the ectodomain of ICOS or CD28 compared to the binding of the ICOSL reference polypeptide for the same ectodomain.

52. The variant ICOSL polypeptide of any of embodiments 37-51, wherein the variant ICOSL polypeptide exhibits increased binding to the ectodomain(s) of ICOS or CD28 compared to the binding of the ICOSL reference polypeptide for the same ectodomain(s).

53. The variant ICOSL polypeptide of any of embodiments 1-52, wherein the binding is increased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

54. The variant ICOSL polypeptide of any of embodiments 1-53, wherein the ICOS is a human ICOS.

55. The variant ICOSL polypeptide of any of embodiments 1-54, wherein the CD28 is a human CD28.

56. The variant ICOSL polypeptide of any of embodiments 1-55, wherein the variant ICOSL polypeptide exhibits decreased binding to the ectodomain of CTLA-4 compared to the binding of the reference ICOSL polypeptide for the same ectodomain.

57. The variant ICOSL polypeptide of embodiment 56, wherein the binding is decreased more than 1.2-fold, 1.5-fold, 2-fold, 3-fold, 4-fold, 5-fold, 6-fold, 7-fold, 8-fold, 9-fold, 10-fold, 20-fold, 30-fold, 40-fold, 50-fold or 60-fold.

58. The variant ICOSL polypeptide of any of embodiments 1-57, wherein the CTLA-4 is a human CTLA-4.

59. The variant ICOSL polypeptide of any of embodiments 1-58, wherein the altered (increased or decreased) binding is altered (increased or decreased) binding affinity.

60. The variant ICOSL polypeptide of any of embodiments 1-59, wherein the variant ICOSL polypeptide comprises up to 1, 2, 3, 4, 5, 6, 7, 8, 9, 10, 11, 12, 13, 14, 15, 16, 17, 18, 19 or 20 amino acid modifications, optionally amino acid substitutions, insertions and/or deletions.

61. The variant ICOSL polypeptide of any of embodiments 1-60, wherein the variant ICOSL polypeptide exhibits at least or at least about 90%, 91%, 92%, 93%, 94%, 95%, 96%, 97%, 98% or 99% sequence identity to the ICOSL reference polypeptide.

62. The variant ICOSL polypeptide of any of embodiments 1-61 that is a soluble protein.

63. The variant ICOSL polypeptide of any of embodiments 1-62, wherein:
the variant ICOSL polypeptide lacks a transmembrane domain and intracellular signaling domain; and/or
when expressed from a cell, the variant ICOSL polypeptide is not expressed on the surface of the cell.

64. The variant ICOSL polypeptide of any of embodiments 1-61, wherein the variant ICOSL polypeptide further comprises a transmembrane domain.

65. The variant ICOSL polypeptide of embodiment 64, wherein the transmembrane domain comprises the sequence of amino acids set forth as residues 257-277 of SEQ ID NO:5 or a functional variant thereof that exhibits at least 85% sequence identity to residues 257-277 of SEQ ID NO:5.

66. The variant ICOSL polypeptide of embodiment 64 or embodiment 65, further comprising a cytoplasmic signaling domain linked to the transmembrane domain.

67. The variant ICOSL polypeptide of embodiment 66, wherein the cytoplasmic signaling domain comprises the sequence of amino acids set forth as residues 278-302 of SEQ ID NO:5 or a functional variant thereof that exhibits at least 85% sequence identity to residues 278-302 of SEQ ID NO:5.

68. The variant ICOSL polypeptide of any of embodiments 1-67 that is deglycosylated or partially deglycosylated compared to the ICOSL reference sequence.

69. An immunomodulatory protein, comprising the variant ICOSL polypeptide of any of embodiments 1-68 and a half-life extending moiety.

70. The immunomodulatory protein of embodiment 69, wherein the half-life extending moiety comprises a multimerization domain, albumin, an albumin-binding polypeptide, Pro/Ala/Ser (PAS), a C-terminal peptide (CTP) of the beta subunit of human chorionic gonadotropin, polyethylene glycol (PEG), long unstructured hydrophilic sequences of amino acids (XTEN), hydroxyethyl starch (HES), an albumin-binding small molecule, or a combination thereof.

71. The immunomodulatory protein of embodiment 69 or embodiment 70, wherein the half-life extending moiety is or comprises Pro/Ala/Ser (PAS) and the variant ICOSL polypeptide is PASylated.

72. The immunomodulatory protein of embodiment 71, wherein the half-life extending moiety comprises the sequence set forth in SEQ ID NO: 904.

73. The immunomodulatory protein of embodiment 69 or embodiment 70, wherein the half-life extending moiety is or comprises a multimerization domain.

74. The immunomodulatory protein of embodiment 73, wherein the multimerization domain is selected from an Fc region of an immunoglobulin, a leucine zipper, an isoleucine zipper or a zinc finger.

75. The immunomodulatory protein of embodiment 73 or embodiment 74, wherein the variant ICOSL polypeptide is linked, directly or indirectly via a linker, to the multimerization domain.

76. The immunomodulatory protein of any of embodiments 73-75, wherein the immunomodulatory protein is a multimer comprising a first variant ICOSL polypeptide linked to a first multimerization domain and a second variant ICOSL polypeptide linked to a second multimerization domain, wherein the first and second multimerization domains interact to form a multimer comprising the first and second variant ICOSL polypeptide.

77. The immunomodulatory protein of embodiment 76, wherein the multimer is a dimer.

78. The immunomodulatory protein of embodiment 76 or embodiment 77, wherein the first variant ICOSL polypeptide and the second variant ICOSL polypeptide are the same.

79. The immunomodulatory protein of embodiment 77 or embodiment 78, wherein the dimer is a homodimer.

80. The immunomodulatory protein of embodiment 77, wherein the dimer is a heterodimer.

81. The immunomodulatory protein of any of embodiments 73-80, wherein the multimerization domain is or comprises an Fc region of an immunoglobulin.

82. The immunomodulatory protein of embodiment 81, wherein the Fc region is of an immunoglobulin G1 (IgG1) or an immunoglobulin G2 (IgG2) protein.

83. The immunomodulatory protein of embodiment 81 or embodiment 82, wherein the immunoglobulin protein is human and/or the Fc region is human.

84. The immunomodulatory protein of any of embodiments 81-83, wherein the Fc region comprises the sequence of amino acids set forth in SEQ ID NO: 227 or a variant thereof that exhibits at least 90%, 91%, 92%, 93%, 94%, 95%, 96%, 97%, 98% or 99% sequence identity to SEQ ID NO:227.

85. The immunomodulatory protein of any of embodiments 81-84, wherein the Fc region comprises the sequence of amino acids set forth in SEQ ID NO: 226 or a variant thereof that exhibits at least 90%, 91%, 92%, 93%, 94%, 95%, 96%, 97%, 98% or 99% sequence identity to SEQ ID NO:226.

86. The immunomodulatory protein of any of embodiments 81-85, wherein the Fc region exhibits one or more effector functions.

87. The immunomodulatory protein of any of embodiments 81-86, wherein the Fc region exhibits one or more reduced effector function compared to a wildtype Fc region, optionally wherein the wildtype human Fc is of human IgG1.

88. The immunomodulatory protein of embodiment 86 or embodiment 87, wherein the one or more effector function is selected from among antibody dependent cellular cytotoxicity (ADCC), complement dependent cytotoxicity, programmed cell death and cellular phagocytosis.

89. The immunomodulatory protein of embodiment 87 or embodiment 88, wherein the Fc region is a variant Fc region comprising one or more amino acid substitutions compared to the wildtype Fc region.

90. The immunomodulatory protein of embodiment 89, wherein the one or more amino acid substitutions of the variant Fc region are selected from N297G, E233P/L234V/L235A/G236del/S267K or L234A/L235E/G237A, wherein the residue is numbered according to the EU index of Kabat.

91. The immunomodulatory protein of embodiment 90, wherein the variant Fc region further comprises the amino acid substitution C220S, wherein the residues are numbered according to the EU index of Kabat.

92. The immunomodulatory protein of any of embodiments 87-91, wherein the Fc region comprises the sequence of amino acid sequence set forth in any of SEQ ID NOS: 476-478 or a sequence of amino acids that exhibits at least 90%, 91%, 92%, 93%, 94%, 95%, 96%, 97%, 98%, 99% or more sequence identity to any of SEQ ID NOS:476-478 and contains the amino acid substitutions.

93. The immunomodulatory protein of any of embodiments 87-92, wherein the Fc region comprises K447del, wherein the residue is numbered according to the EU index of Kabat.

94. The immunomodulatory protein of any of embodiments 87-92 and 93, wherein the Fc region comprises the sequence of amino acid sequence set forth in any of SEQ ID NOS: 632-634 or a sequence of amino acids that exhibits at least 90%, 91%, 92%, 93%, 94%, 95%, 96%, 97%, 98%, 99% or more sequence identity to any of SEQ ID NOS:632-634 and contains the amino acid substitutions.

95. An immunomodulatory protein, comprising:
(a) a variant ICOSL polypeptide comprising one or more amino acid modifications in an immunoglobulin superfamily (IgSF) domain of an ICOSL reference polypeptide, wherein the variant ICOSL polypeptide exhibits altered binding to the ectodomain(s) of ICOS or CD28 compared to the binding of the ICOSL reference polypeptide for the same ectodomain(s); and
(b) a variant Fc region comprising amino acid substitutions selected from N297G/K447del, E233P/L234V/L235A/G236del/S267K/K447del or L234A/L235E/G237A/K447del compared to wildtype human IgG1, wherein the residues are numbered according to the EU index of Kabat.

96. The immunomodulatory protein of embodiment 95 that is a dimer.

97. The immunomodulatory protein of embodiment 95 or embodiment 96, wherein the variant Fc region further comprises the amino acid substitution C220S, wherein the residues are numbered according to the EU index of Kabat.

98. The immunomodulatory protein of any of embodiments 95-97, wherein the Fc region comprises the sequence of amino acid sequence set forth in any of SEQ ID NOS: 632-634 or a sequence of amino acids that exhibits at least 90%, 91%, 92%, 93%, 94%, 95%, 96%, 97%, 98%, 99% or more sequence identity to any of SEQ ID NOS: 632-634 and contains the amino acid substitutions.

99. The immunomodulatory protein of any of embodiments 95-98, wherein the variant ICOSL polypeptide is linked, directly or indirectly via a linker, to the variant Fc region.

100. The immunomodulatory protein of embodiment 75 and embodiment 99, wherein the linker comprises 1 to 10 amino acids.

101. The immunomodulatory protein of embodiment 100, wherein the linker is selected from AAA, G4S (SEQ ID NO:636), (G$_4$S)$_2$ (SEQ ID NO:229) or GSGGGGS linker (SEQ ID NO: 635).

102. An immunomodulatory protein, comprising the variant ICOSL polypeptide of any of embodiments 1-68 linked to a second polypeptide comprising an immunoglobulin superfamily (IgSF) domain.

103. The immunomodulatory protein of embodiment 102, wherein the IgSF domain is affinity modified and exhibits altered binding to one or more of its cognate binding partner(s) compared to the unmodified or wild-type IgSF domain.

104. The immunomodulatory polypeptide of embodiment 103, wherein the IgSF domain exhibits increased binding to one or more of its cognate binding partner(s) compared to the unmodified or wild-type IgSF domain.

105. The immunomodulatory polypeptide of any one of embodiments 102-104, wherein the variant ICOSL polypeptide is a first ICOSL variant polypeptide and the IgSF domain of the second polypeptide is an IgSF domain from a second variant ICOSL polypeptide of any of embodiments 1-68, wherein the first and second ICOSL variant are the same or different.

106. The immunomodulatory protein of any one of embodiments 102-105, wherein the variant ICOSL polypeptide is capable of specifically binding to CD28 or ICOS and the IgSF domain of the second polypeptide is capable of binding to a binding partner other than one specifically bound by the ICOSL variant polypeptide.

107. The immunomodulatory polypeptide of embodiment 106, wherein the IgSF domain is from a member of the B7 family.

108. The immunomodulatory polypeptide of any of embodiments 102-104 and 106, wherein the IgSF domain is a tumor-localizing moiety that binds to a ligand expressed on a tumor or is an inflammatory-localizing moiety that binds to a ligand expressed on a cell or tissue of an inflammatory environment.

109. The immunomodulatory polypeptide of embodiment 108, wherein the ligand is B7H6.

110. The immunomodulatory polypeptide of embodiment 108 or embodiment 109, wherein the IgSF domain is from NKp30.

111. The immunomodulatory polypeptide of any of embodiments 102-110, wherein the IgSF domain is or comprises an IgV domain.

112. The immunomodulatory polypeptide of any of embodiments 102-111, wherein the variant ICOSL polypeptide is or comprise an IgV domain.

113. The immunomodulatory protein of any of embodiments 102-112, wherein the immunomodulatory protein comprises a multimerization domain linked to one or both of the variant ICOSL polypeptide or the second polypeptide comprising the IgSF domain.

114. The immunomodulatory protein of embodiment 113, wherein the multimerization domain is an Fc domain or a variant thereof with reduced effector function.

115. The immunomodulatory protein of any of embodiments 102-114 that is dimeric.

116. The immunomodulatory protein of embodiment 115 that is homodimeric.

117. The immunomodulatory protein of embodiment 116 that is heterodimeric.

118. A conjugate comprising the variant ICOSL polypeptide of any of embodiments 1-68 or immunomodulatory protein of any of embodiments 69-117 and a heterologous moiety.

119. The conjugate of embodiment 118, wherein the variant ICOSL polypeptide is linked, directly or indirectly via a linker, to the heterologous moiety.

120. The conjugate of any of embodiments 118 or embodiment 119, wherein the targeting moiety is a protein, a peptide, nucleic acid, small molecule or nanoparticle.

121. The conjugate of any of embodiments 118-120, wherein the target moiety is a protein or a peptide.

122. The conjugate of embodiment 121, wherein the conjugate is a fusion protein.

123. A fusion protein, comprising a variant ICOSL polypeptide of any of embodiments 1-68 or immunomodulatory protein of any of embodiments 69-117 and a heterologous moiety.

124. The conjugate or fusion protein of any of embodiments 118-123, wherein the moiety is a targeting moiety that specifically binds to a molecule on the surface of a cell.

125. The conjugate or fusion protein of embodiment 124, wherein the targeting moiety specifically binds to a molecule on the surface of an immune cell.

126. The conjugate or fusion protein of embodiment 125, wherein the immune cell is an antigen presenting cell or a lymphocyte.

127. The conjugate or fusion protein of embodiment 124, wherein the targeting moiety is a tumor-localizing moiety that binds to a molecule on the surface of a tumor.

128. The conjugate or fusion protein of any of embodiments 124-127, wherein the targeting moiety binds to a molecule HER1/EGFR, HER2/ERBB2, CD20, CD25 (IL-2Rα receptor), CD33, CD52, CD133, CD206, CEA, CEACAM1, CEACAM3, CEACAM5, CEACAM6, cancer antigen 125 (CA125), alpha-fetoprotein (AFP), Lewis Y, TAG72, Caprin-1, mesothelin, PDGF receptor (PDGFR), PDGF-R α, PD-1, PD-L1, CTLA-4, IL-2 receptor, vascular endothelial growth factor (VEGF), CD30, EpCAM, EphA2, Glypican-3, gpA33, mucins, CAIX, PSMA, folate-binding protein, gangliosides (such as GD2, GD3, GM1 and GM2), VEGF receptor (VEGFR), VEGFR2, VEGF-A, integrin αVβ3, integrin α5β1, ERBB3, MET, IGF1R, EPHA3, TRAILR1, TRAILR2, RANKL, FAP, tenascin, AFP, BCR complex, CD3, CD18, CD44, CTLA-4, gp72, HLA-DR 10 β, HLA-DR antigen, IgE, MUC-1, nuC242, PEM antigen, metalloproteinases, Ephrin receptor, Ephrin ligands, HGF receptor, CXCR4, CXCR4, Bombesin receptor, SK-1antigen, Bcr-ab1, RET, MET, TRKB, TIE2, ALK, ROS, EML4-ALK, ROS1, BRAFV600E, SRC, c-KIT, mTOR, TSC1, TSC2, BTK, KIT, BRCA, CDK 4/6, JAK1, JAK2, BRAF, FLT-3, MEK1, MEK2, SMO or B7-H6 (NCR3LG1).

129. The conjugate or fusion protein of any of embodiments 124-128, wherein the targeting moiety binds to PD-L1.

130. The conjugate or fusion protein of any of embodiments 124-129, wherein the targeting moiety is an antibody or antigen-binding fragment.

131. The conjugate or fusion protein of embodiment 130, wherein the antibody is selected from cetuximab, panitumumab, zalutumumab, nimotuzumab, trastuzumab, Ado-trastuzumab emtansine, Tositumomab (Bexxar®), Rituximab (Rituxan, Mabthera), Ibritumomab tiuxetan (Zevalin), Daclizumab (Zenapax), Gemtuzumab (Mylotarg), Alemtuzumab, CEA-scan Fab fragment, OC125 monoclonal antibody, ab75705, B72.3, Bevacizumab (Avastin®), Afatinib, Axitinib, Bosutinib, Cabozantinib, Ceritinib, Crizotinib, Dabrafenib, Dasatinib, Dinutuximab, Erlotinib, Everolimus, Ibrutinib, Imatinib, Lapatinib, Lenvatinib, Nilotinib, Olaparib, Olaratumab, Palbociclib, Pazopanib, Pertuzumab, Ramucirumab, Regorafenib, Ruxolitinib, Sorafenib, Sunitinib, Temsirolimus, Trametinib, Vandetanib, Vemurafenib, Vismodegib, Basiliximab, Ipilimumab, Nivolumab, pembrolizumab, MPDL3280A, Pidilizumab (CT-011), AMP-224, MSB001078C, or MEDI4736, BMS-935559, LY3300054, atezolizumab, avelumab or durvalumab or is an antigen-binding fragment thereof.

132. The conjugate or fusion protein of embodiment 130 or embodiment 131, wherein the variant ICOSL polypeptide is linked, directly or indirectly via a linker, to the N-terminus of the heavy and/or light chain of the antibody or antigen-binding fragment.

133. The conjugate or fusion protein of embodiment 130 or embodiment 131, wherein the variant ICOSL polypeptide is linked, directly or indirectly via a linker, to the C-terminus of the heavy and/or light chain of the antibody or antigen binding fragment.

134. The conjugate or fusion protein of any of embodiments 118-133, wherein the conjugate is divalent, tetravalent, hexavalent or octavalent.

135. The conjugate or fusion protein of any of embodiments 118-123, wherein the heterologous moiety is or comprises a label for detection or purification of the variant ICOSL polypeptide.

136. A monovalent fusion protein comprising:
(a) a variant ICOSL polypeptide comprising one or more amino acid modifications in an immunoglobulin superfamily (IgSF) domain of an ICOSL reference polypeptide, wherein the variant ICOSL polypeptide exhibits altered binding to the ectodomain(s) of ICOS or CD28 compared to the binding of the ICOSL reference polypeptide for the same ectodomain(s); and
(b) a label for detection or purification of the variant ICOSL polypeptide.

137. The conjugate or fusion protein of embodiment 135 or embodiment 136, wherein the label for detection or purification is selected from a poly-histidine (His) tag, a FLAG-tag, a Myc-tag, or a fluorescent protein-tag.

138. The immunomodulatory protein of any of embodiments 95-101 or the fusion protein of embodiment 136 or embodiment 137, wherein the variant ICOSL polypeptide comprises one or more amino acid modifications are in a position corresponding to position(s) selected from 10, 11, 13, 16, 18, 20, 25, 26, 27, 30, 33, 37, 38, 42, 43, 47, 52, 54, 57, 61, 62, 67, 71, 72, 74, 75, 77, 78, 80, 84, 89, 90, 92, 93, 94, 96, 97, 98, 99, 100, 102, 103, 107, 109, 110, 111, 113, 115, 116, 117, 119, 120, 121, 122, 126, 129, 130, 132, 133, 135, 137, 138, 139, 140, 142, 143, 144, 146, 151, 152, 153, 154, 155, 156, 158, 161, 164, 166, 168, 172, 173, 175, 190, 192, 193, 194, 198, 201, 203, 207, 208, 210, 212, 217, 218, 220, 221, 224, 225, or 227 with reference to SEQ ID NO:32.

139. The immunomodulatory protein or fusion protein of embodiment 138, wherein the one or more amino acid modifications are selected from M10V, M10I, V11E, S13G, E16V, S18R, A20T, A20V, S25G, R26S, F27C, F27S, N30D, Y33del, Q37R, T38P, K42E, T43A, Y47H, N52A, N52C, N52D, N52G, N52H, N52K, N52L, N52M, N52P, N52Q, N52R, N52S, N52T, N52V, N52Y, S54A, S54F, S54P, N57A, N57D, N57E, N57F, N57H, N57K, N57L, N57M, N57P, N57Q, N57S, N57T, N57V, N57W, N57Y, R61C, R61S, Y62F, L67P, A71T, G72R, L74Q, R75Q, D77G, F78L, L80P, N84Q, D89G, E90A, K92R, F93L, H94D, H94E, L96F, L96I, V97A, L98F, S99G, Q100A, Q100D, Q100E, Q100G, Q100K, Q100L, Q100M, Q100N, Q100P, Q100R, Q100S, Q100T, Q100V, L102R, G103E, V107A, V107I, S109G, S109N, V110A, V110D, V110N, E111del, T113E, H115Q, H115R, V116A, A117T, N119Q, F120I, F120S, S121G, V122A, V122M, S126R, S126T, H129P, S130G, S132F, Q133H, E135K, T137A, F138L, T139S, C140del, C140D, S142F, I143T, I143V, N144D, Y146C, V151A, Y152C, Y152H, W153R, I154F, N155H, N155Q, K156M, D158G, L161M, L161P, Q164L, L166Q, N168Q, F172S, L173S, M175T, T190A, T190S, S192G, V193A, V193M, N194D, C198R, N201S, L203F, L203P, N207Q, L208P, V210A, S212G, D217G, D217V, I218N, I218T, E220G, R221G, R221I, R221K, I224V, T225A, T225S, N227K, or a conservative amino acid substitution thereof.

140. The immunomodulatory protein or fusion protein of embodiment 138 or embodiment 139, wherein the ICOSL reference polypeptide comprises (i) the sequence of amino acids set forth in SEQ ID NO:32, (ii) a sequence of amino acids that has at least 95% sequence identity to SEQ ID NO:32; or (iii) a portion of (i) or (ii) comprising an IgV domain or IgC domain or specific binding fragments thereof or both.

141. The immunomodulatory protein or fusion protein of any of embodiments 138-140, wherein the ICOSL reference polypeptide comprises the sequence of amino acids set forth in any of SEQ ID NOS: 196, 545, 600-605 and 623-628.

142. The immunomodulatory protein or fusion protein of any of embodiments 138-141, wherein the ICOSL reference polypeptide consists of the sequence of amino acids set forth in any of SEQ ID NOS: 32, 196, 545, 600-605 and 623-628.

143. A nucleic acid molecule(s), encoding a variant ICOSL polypeptide of any of embodiments 1-68, an immunomodulatory protein of any of embodiments 69-117 and 118-142 or a fusion protein of any of embodiments 123-142.

144. The nucleic acid molecule(s) of embodiment 143 that is synthetic nucleic acid.

145. The nucleic acid molecule(s) of embodiment 143 or embodiment 144 that is cDNA.

146. A vector, comprising the nucleic acid molecule(s) of any of embodiments 143-145.

147. The vector of embodiment 146 that is an expression vector.

148. The vector of embodiment 146 or embodiment 147, wherein the vector is a mammalian expression vector or a viral vector.

149. A cell, comprising the vector of any of embodiments 146-148.

150. The cell of embodiment 149 that is a mammalian cell.

151. The cell of embodiment 149 or embodiment 150 that is a Chinese Hamster Ovary (CHO) cell or a derivative thereof.

152. A method of producing an immunomodulatory protein comprising a variant ICOSL polypeptide, comprising introducing the nucleic acid molecule of any of embodiments 143-145 or vector of any of embodiments 146-148 into a host cell under conditions to express the protein in the cell.

153. The method of embodiment 152, wherein the host cell is a mammalian cell.

154. The method of embodiment 153, wherein the mammalian cell is a Chinese Hamster Ovary cell or a derivative thereof.

155. The method of any of embodiments 152-154, further comprising isolating or purifying the protein from the cell.

156. A protein produced by the method of any of embodiments 152-155.

157. A composition comprising a protein comprising a variant ICOSL polypeptide of any of embodiments 1-68 or an immunomodulatory protein of any of embodiments 69-117, wherein at least 95%, 96%, 97%, 98%, 99% of the individual sequences of the protein or the immunomodulatory protein in the composition have an identical sequence length, optionally wherein the composition is a pharmaceutical composition comprising a pharmaceutically acceptable carrier.

158. The composition of embodiment 157, wherein the protein or immunomodulatory protein is purified from Chinese Hamster Ovary Cells or a derivative thereof.

159. A polynucleotide comprising a nucleic acid encoding a variant ICOSL polypeptide comprising a transmembrane domain of any of embodiments 64-68 and one or more nucleic acid encoding one or more chain of a recombinant antigen receptor.

160. The polynucleotide of embodiment 159, wherein the recombinant antigen receptor is a chimeric antigen receptor (CAR) or an engineered T cell receptor (TCR).

161. The polynucleotide of embodiment 159 or embodiment 160, wherein each of the nucleic acid encoding the variant ICOSL polypeptide and the one or more nucleic acid encoding one or more chain of the recombinant receptor is separated by a nucleic acid encoding a self-cleaving peptide or a peptide that causes ribosome skipping.

162. The polynucleotide of embodiment 161, wherein the polynucleotide comprises the nucleic acid encoding the variant ICOSL polypeptide, a nucleic acid encoding a self-cleaving peptide or a peptide that causes ribosome skipping and a nucleic acid encoding a CAR.

163. The polynucleotide of embodiment 161, wherein the polynucleotide comprises the nucleic acid encoding the variant ICOSL polypeptide, a nucleic acid encoding a first self-cleaving peptide or a peptide that causes ribosome skipping, a nucleic acid encoding one of an engineered TCRalpha chain or an engineered TCRbeta chain, a nucleic acid encoding a second self-cleaving peptide or a peptide that causes ribosome skipping, and a nucleic acid encoding the other of the engineered TCRalpha chain or the engineered TCRbeta chain.

164. The polynucleotide of embodiment 163, wherein the encoded first and second self-cleaving peptide is the same.

165. The polynucleotide of any of embodiments 160-163, wherein the self-cleaving peptide or the peptide that causes ribosome skipping is a T2A, a P2A, a E2A or a F2A.

166. A vector comprising the polynucleotide of any of embodiments 159-165.

167. The vector of embodiment 166, wherein the vector is a viral vector.

168. The vector of embodiment 167, wherein the viral vector is a retroviral vector or a lentiviral vector.

169. An engineered cell comprising the polynucleotide of any of embodiments 159-165 or the vector of any of embodiments 166-168.

170. An engineered cell comprising the variant ICOSL polypeptide of any of embodiments 1-68, the immunomodulatory protein of any of embodiments 69-117, or the fusion protein of any of embodiments 123-142.

171. An engineered cell comprising the nucleic acid molecule of any of embodiments 143-145 or the vector of any of embodiments 146-148.

172. The engineered cell of any of embodiments 169-171, wherein the nucleic acid encoding the variant ICOSL polypeptide, immunomodulatory protein or fusion protein encodes a signal peptide.

173. The engineered cell of any of embodiments 169-172, wherein the variant ICOSL polypeptide, immunomodulatory protein or fusion protein does not comprise a transmembrane domain and/or is not expressed on the surface of the cell.

174. The engineered cell of any of embodiments 169-173, wherein the variant ICOSL polypeptide, immunomodulatory protein or fusion protein is secreted from the engineered cell.

175. The engineered cell of any of embodiments 169-171, wherein the engineered cell comprises a variant ICOSL polypeptide comprising a transmembrane domain of any of embodiments 64-68.

176. The engineered cell of any of embodiments 169-171 and 175, wherein the variant ICOSL polypeptide is expressed on the surface of the cell.

177. The engineered cell of any of embodiments 169-176, wherein the cell is an immune cell.

178. The engineered cell of embodiment 177, wherein the immune cell is an antigen presenting cell (APC) or a lymphocyte.

179. The engineered cell of any of embodiments 169-178 that is a primary cell.

180. The engineered cell of any of embodiments 169-179, wherein the cell is a mammalian cell.

181. The engineered cell of any of embodiments 169-180, wherein the cell is a human cell.

182. The engineered cell of any of embodiments 169-181, wherein the lymphocyte is a T cell.

183. The engineered cell of embodiment 178, wherein the engineered cell is an APC and the APC is an artificial APC.

184. The engineered cell of any of embodiments 169-183, further comprising a chimeric antigen receptor (CAR) or an engineered T-cell receptor.

185. A pharmaceutical composition, comprising the variant ICOSL polypeptide of any of embodiments 1-68, the immunomodulatory protein of any of embodiments 69-117, a conjugate or fusion protein of any of embodiments 118-142 or an engineered cell of any of embodiments 169-184 or an infectious agent of an of embodiments 216-227.

186. The pharmaceutical composition of embodiment 185, comprising a pharmaceutically acceptable excipient.

187. The pharmaceutical composition of embodiment 185 or 186, wherein the pharmaceutical composition is sterile.

188. An article of manufacture comprising the pharmaceutical composition of any of embodiments 185-187 in a vial.

189. The article of manufacture of embodiment 188, wherein the vial is sealed.

190. A kit comprising the composition of any of embodiments 157-158 and 185-187, and instructions for use.

191. A kit comprising the article of manufacture according to embodiment 189 and 190, and instructions for use.

192. A method of modulating an immune response in a subject, comprising administering the pharmaceutical composition of any of embodiments 157-158 and 185-187 to the subject.

193. A method of modulating an immune response in a subject, comprising administering the engineered cells of any of embodiments 169-184.

194. The method of embodiment 193, wherein the engineered cells are autologous to the subject.

195. The method of embodiment 193, wherein the engineered cells are allogenic to the subject.

196. The method of any of embodiments 193-195, wherein modulating the immune response treats a disease or condition in the subject.

197. The method of any of embodiments 193-196, wherein the immune response is increased.

198. The method of any of embodiments 192, 196 and 197, wherein an immunomodulatory protein or conjugate comprising a variant ICOSL polypeptide linked to a tumor-localizing moiety is administered to the subject.

199. The method of embodiment 198, wherein the tumor-localizing moiety is or comprises a binding molecule that recognizes a tumor antigen.

200. The method of embodiment 199, wherein the binding molecule comprises an antibody or an antigen-binding fragment thereof or comprises a wild-type IgSF domain or variant thereof.

201. The method of any of embodiments 192 and 196-200, wherein the immunomodulatory protein of any of embodiments 102-117 or the conjugate or fusion protein of any of embodiments 118-142 is administered to the subject.

202. The method of any of embodiments 193-197, wherein a variant ICOSL polypeptide that is a transmembrane immunomodulatory protein is administered to the subject.

203. The method of any of embodiments 193-197 and 202, wherein the engineered cell comprising a variant ICOSL polypeptide that is a transmembrane immunomodulatory protein of any of embodiments 64-68 is administered to the subject.

204. The method of embodiment 192-203, wherein the disease or condition is a tumor or cancer.

205. The method of any one of embodiments 192-204, wherein the disease or condition is selected from melanoma, lung cancer, bladder cancer, a hematological malignancy, liver cancer, brain cancer, renal cancer, breast cancer, pancreatic cancer, colorectal cancer, spleen cancer, prostate cancer, testicular cancer, ovarian cancer, uterine cancer, gastric carcinoma, a musculoskeletal cancer, a head and neck cancer, a gastrointestinal cancer, a germ cell cancer, or an endocrine and neuroendocrine cancer.

206. The method of any of embodiments 192-196, wherein the immune response is decreased.

207. The method of any of embodiments 192-196 and 206, wherein a variant ICOSL polypeptide or immunomodulatory protein that is soluble is administered to the subject.

208. The method of embodiment 207, wherein the soluble immunomodulatory protein is an immunomodulatory Fc fusion protein.

209. The method of any of embodiments 192-196 and 206-208, wherein a variant ICOSL polypeptide of any of embodiments 1-63 and 68, the immunomodulatory protein of any of embodiments 70-101 or the fusion protein of embodiment 136 and 137 is administered to the subject.

210. The method of any of embodiments 192-196 and 206-208, wherein an engineered cell comprising a secretable variant ICOSL polypeptide is administered to the subject.

211. The method of any of embodiments 192-196, 206-208 and 210, wherein an engineered cell of any of embodiments 169-174 and 177-184 is administered to the subject.

212. The method of any of embodiments 192-196, 206-208 and 210, wherein an infectious agent encoding a variant ICOSL polypeptide that is a secretable immunomodulatory protein is administered to the subject, optionally under conditions in which the infectious agent infects a tumor cell or immune cell and the secretable immunomodulatory protein is secreted from the infected cell.

213. The method of any of embodiments 192-196 and 206-212, wherein the disease or condition is an inflammatory or autoimmune disease or condition.

214. The method of any of embodiments 192-196 and 206-213, wherein the disease or condition is an Antineutrophil cytoplasmic antibodies (ANCA)-associated vasculitis, a vasculitis, an autoimmune skin disease, transplantation, a Rheumatic disease, an inflammatory gastrointestinal disease, an inflammatory eye disease, an inflammatory neurological disease, an inflammatory pulmonary disease, an inflammatory endocrine disease, or an autoimmune hematological disease.

215. The method of embodiment 213 or embodiment 214, wherein the disease or condition is selected from inflammatory bowel disease, transplant, Crohn's disease, ulcerative colitis, multiple sclerosis, asthma, rheumatoid arthritis, or psoriasis.

216. An infectious agent, comprising a nucleic acid molecule encoding a variant ICOSL polypeptide of any of embodiments 1-68 or an immunomodulatory protein of any of embodiments the immunomodulatory protein of any of embodiments 69-117, or the fusion protein of any of embodiments 123-142.

217. The infectious agent of embodiment 216, wherein the encoded variant ICOSL polypeptide, immunomodulatory protein or fusion protein does not comprise a transmembrane domain and/or is not expressed on the surface of a cell in which it is expressed.

218. The infectious agent of embodiment 216 or embodiment 217, wherein the encoded variant ICOSL polypeptide, immunomodulatory protein or fusion protein is secreted from the infectious agent when it is expressed.

219. The infectious agent of embodiment 218, wherein the encoded variant ICOSL polypeptide comprises a transmembrane domain.

220. The infectious agent of embodiment 216, embodiment 217 or embodiment 219, wherein the encoded variant ICOSL polypeptide is expressed on the surface of a cell in which it is expressed.

221. The infectious agent of any of embodiments 216-220, wherein the infectious agent is a bacteria or a virus.

222. The infectious agent of embodiment 221, wherein the virus is an oncolytic virus.

223. The infectious agent of embodiment 222, wherein the oncolytic virus is an adenoviruses, adeno-associated viruses, herpes viruses, Herpes Simplex Virus, Vesticular Stomatic virus, Reovirus, Newcastle Disease virus, parvovirus, measles virus, vesticular stomatitis virus (VSV), Coxsackie virus or a Vaccinia virus.

224. The infectious agent of embodiment 222, wherein the virus specifically targets dendritic cells (DCs) and/or is dendritic cell-tropic.

225. The infectious agent of embodiment 224, wherein the virus is a lentiviral vector that is pseudotyped with a modified Sindbis virus envelope product.

226. The infectious agent of any of embodiments 216-225, further comprising a nucleic acid molecule encoding a further gene product that results in death of a target cell or that can augment or boost an immune response.

227. The infectious agent of embodiment 226, wherein the further gene product is selected from an anticancer agent, anti-metastatic agent, an antiangiogenic agent, an immunomodulatory molecule, an immune checkpoint inhibitor, an antibody, a cytokine, a growth factor, an antigen, a cytotoxic gene product, a pro-apoptotic gene product, an anti-apoptotic gene product, a cell matrix degradative gene, genes for tissue regeneration or a reprogramming human somatic cells to pluripotency.

X. EXAMPLES

The following examples are included for illustrative purposes only and are not intended to limit the scope of the invention.

Example 1

Example 1 Generation of Mutant DNA Constructs of IgSF Domains

Example 1 describes the generation of mutant DNA constructs of human ICOSL IgSF domains for translation and expression on the surface of yeast as yeast display libraries.

A. Degenerate Libraries

Mutant DNA constructs encoding a variant of the ECD domain of ICOSL were generated. Constructs were generated based on a wildtype human ICOSL sequence set forth in SEQ ID NO:32 containing the ECD domain as follows:

DTQEKEVRAMVGSDVELSCACPEGSRFDLNDVYVYWQTSESKTVVTYHI

PQNSSLENVDSRYRNRALMSPAGMLRGDFSLRLFNVTPQDEQKFHCLVL

SQSLGFQEVLSVEVTLHVAANFSVPVVSAPHSPSQDELTFTCTSINGYP

RPNVYWINKTDNSLLDQALQNDTVFLNMRGLYDVVSVLRIARTPSVNIG

CCIENVLLQQNLTVGSQTGNDIGERDKITENPVSTGEKNAAT

For libraries that target specific residues for complete or partial randomization with degenerate codons, the DNA encoding SEQ ID NO:32 was ordered from Integrated DNA Technologies (Coralville, Iowa) as a set of overlapping oligonucleotides of up to 80 base pairs (bp) in length. To generate a library of diverse variants of the ECD, the oligonucleotides contained desired degenerate codons, such as specific mixed base sets to code for various amino acid substitutions, at desired amino acid positions. Degenerate codons were generated using an algorithm at the URL: rosettadesign.med.unc.edu/SwiftLib/.

In general, positions to mutate and degenerate codons were chosen from homology models (ICOSL) of the target-ligand pairs of interest to identify ligand contact residues, such as target side chain residues that interact with the ligand, as well as residues that are at the protein interaction interface. This analysis was performed using a structure viewer available at the URL: spdbv.vital-it.ch).

The next step in library design was the alignment of human, mouse, rat and monkey ICOSL sequences to identify conserved residues. Based on this analysis, conserved target residues were mutated with degenerate codons that only specified conservative amino acid changes plus the wild-type residue. Residues that were not conserved, were mutated more aggressively, but also included the wild-type residue. Degenerate codons that also encoded the wild-type residue were deployed to avoid excessive mutagenesis of target protein. For the same reason, only up to 20 positions were targeted for mutagenesis at a time. These residues were a combination of contact residues and non-contact interface residues.

The oligonucleotides were dissolved in sterile water, mixed in equimolar ratios, heated to 95° C. for five minutes and slowly cooled to room temperature for annealing. ECD-specific oligonucleotide primers that anneal to the start and end of the ECDs, respectively, were then used to generate PCR product. ECD-specific oligonucleotides which overlap by 40-50 bp with a modified version of pBYDS03 cloning vector (Life Technologies USA), beyond and including the BamH1 and Kpn1 cloning sites, were then used to amplify 100 ng of PCR product from the prior step to generate a total of 5 μg of DNA. Both PCR's were by polymerase chain reaction (PCR) using OneTaq 2×PCR master mix (New England Biolabs, USA). The second PCR products were purified using a PCR purification kit (Qiagen, Germany) and resuspended in sterile deionized water.

To prepare for library insertion, a modified yeast display version of vector pBYDS03 was digested with BamHI and KpnI restriction enzymes (New England Biolabs, USA) and the large vector fragment was gel-purified and dissolved in sterile, deionized water. Electroporation-ready DNA for the next step was generated by mixing 12 μg of library DNA for every electroporation with 4 μg of linearized vector in a total volume of 50 μl deionized and sterile water. An alternative way to generate targeted libraries, was to carry out site-directed mutagenesis (Multisite kit, Agilent, USA) of the target ECD with oligonucleotides containing degenerate codons. This approach was used to generate sublibraries that only target specific stretches of target protein for mutagenesis. In these cases, sublibraries were mixed before proceeding to the selection steps. In general, library sizes were in the range of 10E7 to 10E8 clones, except that sublibraries were only in the range of 10E4 to 10E5. Large libraries and sublibraries are generated for ICOSL.

B. Random Libraries

Random libraries were also constructed to identify variants of the ECD of ICOSL set forth in SEQ ID NO:32 containing the ECD domain. DNA encoding the wild-type ECD was cloned between the BamHI and KpnI restriction sites of modified yeast display vector pBYDS03. The DNA was then mutagenized with the Genemorph II Kit (Agilent, USA) to generate an average of three to five amino acid changes per library variant. Mutagenized DNA was then amplified by the two-step PCR and further processed as described above for targeted libraries.

Example 2

Introduction of DNA Libraries into Yeast

Example 2 describes the introduction of ICOSL DNA libraries into yeast.

To introduce degenerate and random library DNA into yeast, electroporation-competent cells of yeast strain BJ5464 (ATCC.org; ATCC number 208288) were prepared and electroporated on a Gene Pulser II (Biorad, USA) with the electroporation-ready DNA from the step above essentially as described (Colby, D. W. et al. 2004 Methods Enzymology 388, 348-358). The only exception is that transformed cells were grown in non-inducing minimal selective SCD-Leu medium to accommodate the LEU2 selectable marker carried by modified plasmid pBYDS03. One liter of SCD-Leu media consists of 14.7 grams sodium citrate, 4.29 grams citric acid monohydrate, 20 grams dextrose, 6.7 grams yeast nitrogen base, and 1.6 grams yeast synthetic drop-out media supplement without leucine. The Medium was filter sterilized before use using a 0.22 μm vacuum filter device.

Library size was determined by plating serial dilutions of freshly recovered cells on SCD-Leu agar plates and then extrapolating library size from the number of single colonies from plating that generated at least 50 colonies per plate. In general, library sizes ranged from 10E8 to 10E9 transformants based on this dilution assay. The remainder of the electroporated culture was grown to saturation in SCD-Leu and cells from this culture were subcultured (e.g. 1/100) into fresh SCD-Leu once more to minimize the fraction of untransformed cells. To maintain library diversity, this subculturing step was carried out using an inoculum that contained at least 10× more cells than the calculated library size. Cells from the second saturated culture were resuspended in fresh medium containing sterile 25% (weight/volume) glycerol to a density of 10E10/mL and frozen and stored at −80° C. (frozen library stock).

Library size was determined by plating dilutions of freshly recovered cells on SCD-Leu agar plates and then extrapolating library size from the number of single colonies from a plating that generate at least 50 colonies per plate.

To segregate plasmid from cells that contain two or more different library clones, a number of cells corresponding to 10 times the library size, were taken from the overnight SCD-Leu culture and subcultured 1/100 into fresh SCD-Leu medium and grown overnight. Cells from this overnight culture were resuspended in sterile 25% (weight/volume) glycerol to a density of 10E10/mL and frozen and stored at −80° C. (frozen library stock).

Example 3

Yeast Selection

Example 3 describes the selection of yeast expressing affinity modified variants of ICOSL.

A number of cells equal to at least 10 times the library size were thawed from individual library stocks, suspended to 0.1×10E6 cells/mL in non-inducing SCD-Leu medium, and grown overnight. The next day, a number of cells equal to 10 times the library size were centrifuged at 2000 RPM for two minutes and resuspended to 0.5×10E6 cells/mL in inducing SCDG-Leu media. One liter of the SCDG-Leu induction media consists of 5.4 grams $Na_2HPO_4$, 8.56 grams of $NaH_2PO_4.H_2O$, 20 grams galactose, 2.0 grams dextrose, 6.7 grams Difco yeast nitrogen base, and 1.6 grams of yeast synthetic drop out media supplement without leucine dissolved in water and sterilized through a 0.22 μm membrane filter device. The culture was grown for two days at 20° C. to induce expression of library proteins on the yeast cell surface.

Cells were processed with magnetic beads to reduce non-binders and enrich for all ICOSL variants with the ability to bind their exogenous recombinant counter-structure proteins. This was then followed by two to three rounds of flow cytometry sorting using exogenous counter-structure protein staining to enrich the fraction of yeast cells that displays improved binders. Magnetic bead enrichment and selections by flow cytometry are essentially as described in Miller, K. D. Current Protocols in Cytometry 4.7.1-4.7.30, July 2008.

With ICOSL libraries, target ligand proteins were sourced from R&D Systems (USA) as follows: human rCD28.Fc (i.e., recombinant CD28-Fc fusion protein), rCTLA4.Fc and rICOS.Fc. Magnetic streptavidin beads were obtained from New England Biolabs, USA. For biotinylation of counter-structure protein, biotinylation kit cat #21955, Life Technologies, USA, was used. For two-color, flow cytometric sorting, a Becton Dickinson FACS Aria II sorter was used. ICOSL display levels were monitored with an anti-hemagglutinin antibody labeled with Alexafluor 488 (Life Technologies, USA). Ligand binding Fc fusion proteins rCD28.Fc, rCTLA4.Fc, or rICOS.Fc were detected with PE conjugated human Ig specific goat Fab (Jackson ImmunoResearch, USA). Doublet yeast were gated out using forward scatter (FSC)/side scatter (SSC) parameters, and sort gates were based upon higher ligand binding detected in FL4 that possessed more limited tag expression binding in FL1.

Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

For ICOSL, the second sort outputs (F2) were compared to parental ICOSL yeast for binding of each rICOS.Fc, rCD28.Fc, and rCTLA4.Fc by double staining each population with anti-HA (hemagglutinin) tag expression and the anti-human Fc secondary to detect ligand binding.

In the case of ICOSL yeast variants selected for binding to ICOS, the F2 sort outputs gave Mean Fluorescence Intensity (MFI) values of 997, when stained with 5.6 nM rICOS.Fc, whereas the parental ICOSL strain MFI was measured at 397 when stained with the same concentration of rICOS.Fc. This represents a roughly three-fold improvement of the average binding in this F2 selected pool of clones, and it is predicted that individual clones from that pool will have much better improved MFI/affinity when individually tested.

In the case of ICOSL yeast variants selected for binding to CD28, the F2 sort outputs gave MFI values of 640 when stained with 100 nM rCD28.Fc, whereas the parental ICOSL strain MFI was measured at 29 when stained with the same concentration of rCD28.Fc (22-fold improvement). In the case of ICOSL yeast variants selected for binding to CTLA4, the F2 sort outputs gave MFI values of 949 when stained with 100 nM rCTLA4.Fc, whereas the parental ICOSL strain MFI was measured at 29 when stained with the same concentration of rCTLA4.Fc (32-fold improvement).

Importantly, the MFIs of all F2 outputs described above when measured with the anti-HA tag antibody on FL1 did not increase and sometimes went down compared to wild-type strains, indicating that increased binding was not a function of increased expression of the selected variants on the surface of yeast, and validated gating strategies of only selecting mid to low expressors with high ligand binding.

Selected variant ICOSL ECD domains were further formatted as fusion proteins and tested for binding and functional activity as described below.

Example 4

Reformatting Selection Outputs as Fc-Fusions and in Various Immunomodulatory Protein Types Example 4 describes reformatting of selection outputs identified in Example 3 as immunomodulatory proteins containing an affinity modified (variant) extracellular domain (ECD) of ICOSL fused to an Fc molecule (variant ECD-Fc fusion molecules).

Output cells from final flow cytometric ICOSL sorts were grown to terminal density in SCD-Leu medium. Plasmid DNA from each output was isolated using a yeast plasmid DNA isolation kit (Zymo Research, USA). For Fc fusions, PCR primers with added restriction sites suitable for cloning into the Fc fusion vector of choice were used to batch-amplify from the plasmid DNA preps the coding DNA's for the mutant target ECD's. After restriction digestion, the PCR products were ligated into an appropriate Fc fusion vector followed by chemical transformation into strain E. coli XL1 Blue (Agilent, USA) or NEB5alpha (New England Biolabs, USA) as directed by supplier. Exemplary of an Fc fusion vector is pFUSE-hIgG1-Fc2 (InvivoGen, USA).

Dilutions of transformation reactions were plated on LB-agar containing 100 μg/mL carbenicillin (Teknova, USA) to generate single colonies. Up to 96 colonies from each transformation were then grown in 96 well plates to saturation overnight at 37° C. in LB-broth (Teknova cat #L8112) and a small aliquot from each well was submitted for DNA sequencing of the ECD insert in order to identify the mutation(s) in all clones. Sample preparation for DNA sequencing was carried out using protocols provided by the service provider (Genewiz; South Plainfield, N.J.). After removal of sample for DNA sequencing, glycerol was then added to the remaining cultures for a final glycerol content of 25% and plates were stored at −20° C. for future use as master plates (see below). Alternatively, samples for DNA sequencing were generated by replica plating from grown liquid cultures onto solid agar plates using a disposable 96 well replicator (VWR, USA). These plates were incubated overnight to generate growth patches and the plates were submitted to Genewiz for DNA sequencing following their specifications. In some instances, resequencing was performed to verify mutations.

After analysis of the Genewiz-generated DNA sequencing data, clones of interest were recovered from master plates and individually grown to saturation in 5 mL liquid LB-broth containing 100 µg/mL carbenicillin (Teknova, USA) and 2 mL of each culture were then used for preparation of approximately 10 µg of miniprep plasmid DNA of each clone using a standard kit such as the Pureyield kit (Promega, USA). Identification of clones of interest generally involved the following steps. First, DNA sequence data files were downloaded from the Genewiz website. All sequences were then manually curated so that they start at the beginning of the ECD coding region. The curated sequences were then batch-translated using a suitable program available at the URL: www.ebi.ac.uk/Tools/st/emboss_transeq/. The translated sequences were then aligned using a suitable program available at the URL: multalin.toulouse.inra.fr/multalin/multalin.html. Alternatively, Genewiz sequences were processed to generate alignments using Ugene software (http://ugene.net).

Clones of interest were then identified using the following criteria: 1.) identical clone occurs at least two times in the alignment and 2.) a mutation occurs at least two times in the alignment and preferably in distinct clones. Clones that meet at least one of these criteria were clones that have been enriched by the sorting process most likely due to improved binding.

To generate recombinant immunomodulatory proteins that are Fc fusion proteins containing an ECD of ICOSL with at least one affinity-modified domain (e.g. variant ICOSL ECD-Fc), the encoding nucleic acid molecule was generated to encode a protein designed as follows: signal peptide followed by variant (mutant) ICOSL ECD followed by a linker of three alanines (AAA) followed by a human IgG1 Fc containing the mutation N82G with reference to wild-type human IgG1 Fc set forth in SEQ ID NO: 226 (corresponding to N297G by EU numbering). This exemplary Fc also contained stabilizing cysteine mutations R77C and V87C and replacement of the cysteine residue to a serine residue at position 220 (C220S) by EU numbering (corresponding to position 5 (C5S) with reference with reference to wild-type human IgG1 Fc set forth in SEQ ID NO:226 (corresponding to R292C, V302C and C220S, respectively, by EU numbering). In some cases, the NotI cloning site which contributes to the AAA linker sequence was deleted to generate a direct fusion of the ICOSL ECD and the beginning of the Fc. Since the construct does not include any antibody light chains that can form a covalent bond with a cysteine, the human IgG1 Fc also contains replacement of the cysteine residues to a serine residue at position 5 (C5S) compared to the wild-type or unmodified Fc set forth in SEQ ID NO: 226.

Example 5

Expression and Purification of Fc-Fusions

Example 5 describes the high throughput expression and purification of Fc-fusion proteins containing variant ECD ICOSL as described in the above Examples.

Recombinant variant Fc fusion proteins were produced from suspension-adapted human embryonic kidney (HEK) 293 cells using the Expi293 expression system (Invitrogen, USA). 4 µg of each plasmid DNA from the previous step was added to 200 µL Opti MEM (Invitrogen, USA) at the same time as 10.8 µL ExpiFectamine was separately added to another 200 µL Opti-MEM. After 5 minutes, the 200 µL of plasmid DNA was mixed with the 200 µL of ExpiFectamine and was further incubated for an additional 20 minutes before adding this mixture to cells. Ten million Expi293 cells were dispensed into separate wells of a sterile 10 ml, conical bottom, deep 24 well growth plate (Thomson Instrument Company, USA) in a volume 3.4 ml Expi293 media (Invitrogen, USA). Plates were shaken for 5 days at 120 RPM in a mammalian cell culture incubator set to 95% humidity and 8% $CO_2$. Following a 5 day incubation, cells were pelleted and culture supernatants were retained.

Proteins were purified from supernatants using a high throughput 96 well Protein A purification kit using the manufacturer's protocol (Catalog number 45202, Life Technologies, USA). Resulting elution fractions were buffer exchanged into PBS using Zeba 96 well spin desalting plate (Catalog number 89807, Life Technologies, USA) using the manufacturer's protocol. Purified protein was quantitated using 280 nm absorbance measured by Nanodrop instrument (Thermo Fisher Scientific, USA), and protein purity was assessed by loading 5 µg of protein on NUPAGE pre-cast, polyacrylamide gels (Life Technologies, USA) under denaturing and reducing conditions and subsequent gel electrophoresis. Proteins were visualized in gel using standard Coomassie staining.

Example 6

Assessment of Binding and Activity of Affinity-Matured IgSF Domain-Containing Molecules A. Binding to Cell-Expressed Counter Structures This Example describes Fc-fusion binding studies of purified proteins from the above Examples to assess specificity and affinity of ICOSL domain variant immunomodulatory proteins for cognate binding partners.

To produce cells expressing cognate binding partners, full-length mammalian surface expression constructs for each of human CD28 and ICOS were designed in pcDNA3.1 expression vector (Life Technologies) and sourced from Genscript, USA. Binding studies were carried out on transfected HEK293 cells generated to express the full-length mammalian surface ligands using the transient transfection system (Life Technologies, USA) described above. As a control, binding to mock (non-transfected) cells also was assessed. The number of cells needed for the experiment was determined, and the appropriate 30 mL scale of transfection was performed using the manufacturer's suggested protocol. For each CD28, ICOS or mock 30 mL transfection, 75 million Expi293F cells were incubated with 30 µg expression construct DNA and 1.5 ml diluted ExpiFectamine 293 reagent for 48 hours, at which point cells were harvested for staining.

For staining by flow cytometry, 200,000 cells of appropriate transient transfection or negative control (mock) were plated in 96 well round bottom plates. Cells were spun down and resuspended in staining buffer (PBS (phosphate buffered saline), 1% BSA (bovine serum albumin), and 0.10% sodium azide) for 20 minutes to block non-specific binding. Afterwards, cells were centrifuged again and resuspended in staining buffer containing 100 nM to 1 nM variant immunomodulatory protein, depending on the experiment of each candidate CD80 variant Fc, ICOSL variant Fc, or stacked IgSF variant Fc fusion protein in 50 µL. Primary staining was performed on ice for 45 minutes, before washing cells in staining buffer twice. PE-conjugated anti-human Fc (Jackson ImmunoResearch, USA) was diluted 1:150 in 50 µL staining buffer and added to cells and incubated another 30 minutes on ice. Secondary antibody was washed out twice, cells were fixed in 4% formaldehyde/PBS, and samples were analyzed on FACScan flow cytometer (Becton Dickinson, USA) or a Hypercyt flow cytometer (Intellicyte, USA).

Mean Fluorescence Intensity (MFI) was calculated for each transfectant and negative parental line with Cell Quest Pro software (Becton Dickinson, USA) or a Hypercyt flow cytometer (Intellicyte, USA).

B. Bioactivity Characterization

This Example further describes Fc-fusion variant protein bioactivity characterization in human primary T cell in vitro assays.

1. Mixed Lymphocyte Reaction (MLR)

Soluble rICOSL.Fc bioactivity was tested in a human Mixed Lymphocyte Reaction (MLR). Human primary dendritic cells (DC) were generated by culturing monocytes isolated from PBMC (BenTech Bio, USA) in vitro for 7 days with 500 U/mL rIL-4 (R&D Systems, USA) and 250 U/mL rGM-CSF (R&D Systems, USA) in Ex-Vivo 15 media (Lonza, Switzerland). 10,000 matured DC and 100,000 purified allogeneic CD4+ T cells (BenTech Bio, USA) were co-cultured with ICOSL variant Fc fusion proteins and controls in 96 well round bottom plates in 200 µl final volume of Ex-Vivo 15 media. On day 5, IFN-gamma secretion in culture supernatants was analyzed using the Human IFN-gamma Duoset ELISA kit (R&D Systems, USA). Optical density was measured by VMax ELISA Microplate Reader (Molecular Devices, USA) and quantitated against titrated rIFN-gamma standard included in the IFN-gamma Duo-set kit (R&D Systems, USA). A second MLR protocol consisted of human primary dendritic cells (DC) generated by culturing monocytes isolated from PBMC (BenTech Bio, USA) in vitro for 7 days with 50 ng/mL rIL-4 (R&D Systems, USA) and 80 ng/mL rGM-CSF (R&D Systems, USA) in Ex-Vivo 15 media (Lonza, Switzerland). On days 3 and 5, half of the media was removed and replaced with fresh media containing 50 ng/mL rIL-4 and 80 ng/mL rGM-CSF. To fully induce DC maturation, lipopolysaccharide (LPS) (InvivoGen Corp., USA) was added at 100 ng/mL to the DC cultures on day 6 and cells were incubated for an additional 24 hours. Approximately, 10,000 matured DC and 100,000 purified allogeneic CD3+ T cells (BenTech Bio, USA) were co-cultured with ICOSL variant Fc fusion proteins and controls in 96 well round bottom plates in 200 µl final volume of Ex-Vivo 15 media. On day 4-5, IFN-gamma secretion in culture supernatants was analyzed using the Human IFN-gamma Duoset ELISA kit (R&D Systems, USA). Optical density was measured on a BioTek Cytation Multimode Microplate Reader (BioTek Corp., USA) and quantitated against titrated rIFN-gamma standard included in the IFN-gamma Duo-set kit (R&D Systems, USA).

2. Anti-CD3 Coimmobilization Assay

Costimulatory bioactivity of ICOSL fusion variants was determined in anti-CD3 coimmobilization assays. 1 nM or 10 nM mouse anti-human CD3 (OKT3, Biolegends, USA) was diluted in PBS with 1 nM to 80 nM rICOSL.Fc variant proteins. This mixture was added to tissue culture treated flat bottom 96 well plates (Corning, USA) overnight to facilitate adherence of the stimulatory proteins to the wells of the plate. The next day, unbound protein was washed off the plates and 100,000 purified human pan T cells (BenTech Bio, US) or human T cell clone BC3 (Astarte Biologics, USA) were added to each well in a final volume of 200 µl of Ex-Vivo 15 media (Lonza, Switzerland). In some instances, human pan T cells were labeled with 0.25 uM carboxyfluorescein succinimidyl ester (CFSE, ThermoFisher Scientific, USA). Cells were cultured 3 days before harvesting culture supernatants and measuring human IFN-gamma levels with Duoset ELISA kit (R&D Systems, USA) as mentioned above. Cellular proliferation was determined by the percent of input cells that entered division as measured by CFSE dilution on cells stained with fluorescently-conjugated anti-CD4, anti-CD8 antibodies (BD, USA) or total T cells via flow cytometric analysis on an LSR II (BD, USA), C. Results Results for the binding and activity studies for exemplary tested variants are shown in Table 7 which indicates exemplary IgSF domain amino acid substitutions (replacements) in the ECD of ICOSL selected in the screen for affinity-maturation against the respective cognate structures ICOS and CD28. In the Tables, the exemplary amino acid substitutions are designated by amino acid position number corresponding to the respective reference (e.g., unmodified) ECD sequence as follows. For example, the reference (e.g., unmodified) ECD sequence in Table 7 (WT ICOSL) is the (e.g., unmodified) ICOSL ECD sequence set forth in SEQ ID NO: 32. The amino acid position is indicated in the middle, with the corresponding reference (e.g. unmodified or wild-type) amino acid listed before the number and the identified variant amino acid substitution listed after the number. Column 2 sets forth the SEQ ID NO identifier for the variant ECD for each variant ECD-Fc fusion molecule.

Also shown is the binding activity as measured by the Mean Fluorescence Intensity (MFI) value for binding of each variant Fc-fusion molecule to cells transfected to express the cognate ligand and the ratio of the MFI compared to the binding of the corresponding reference (e.g., unmodified) ECD-Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/mL) generated either i) with the indicated variant ECD-Fc fusion molecule coimmoblized with anti-CD3 or ii) with the indicated variant ECD-Fc fusion molecule in an MLR assay. The Table also depicts the ratio of IFN-gamma produced by each variant ECD-Fc compared to the corresponding reference (e.g., unmodified or wild-type) ECD-Fc in both functional assays.

As shown, the selections resulted in the identification of a number of ICOSL IgSF domain variants that were affinity-modified to exhibit increased binding for at least one, and in some cases more than one, cognate counter structure ligand. In addition, the results showed that affinity modification of the variant molecules also exhibited improved activities to both increase and/or decrease immunological activity depending on the format of the molecule. For example, coimmobilization of the ligand likely provides a multivalent interaction with the cell to cluster or increase the avidity to favor agonist activity and increase T cell activation compared to the reference (e.g. unmodified or wildtype) ECD-Fc molecule not containing the amino acid replacement(s). However, when the molecule is provided as a bivalent Fc molecule in solution, the same IgSF domain variants exhibited an antagonist activity to decrease T cell activation compared to the reference (e.g. unmodified or wildtype) ECD-Fv molecule not containing the amino acid replacement(s).

TABLE 7

ICOSL variants selected against CD28 or ICOS. Molecule sequences, binding data, and costimulatory bioactivity data.

| ICOSL mutation(s) | SEQ ID NO (ECD) | Binding | | Coimmobilization with anti-CD3 IFN-gamma pg/mL (parental ratio) | MLR IFN-gamma levels pg/mL (parental ratio) |
|---|---|---|---|---|---|
| | | ICOS OD (parental ratio) | CD28 MFI (parental ratio) | | |
| N52S | 109 | 1.33 (1.55) | 162 (9.00) | 1334 (1.93) | 300 (0.44) |
| N52H | 110 | 1.30 (1.51) | 368 (20.44) | 1268 (1.83) | 39 (0.06) |
| N52D | 111 | 1.59 (1.85) | 130 (7.22) | 1943 (2.80) | 190 (0.28) |
| N52Y/N57Y/F138L/L203P | 112 | 1.02 (1.19) | 398 (22.11) | 510* (1.47*) | 18 (0.03) |
| N52H/N57Y/Q100P | 113 | 1.57 (1.83) | 447 (24.83) | 2199 (3.18) | 25 (0.04) |
| N52S/Y146C/Y152C | 114 | 1.26 (1.47) | 39 (2.17) | 1647 (2.38) | 152 (0.22) |
| N52H/C198R | 115 | 1.16 (1.35) | 363 (20.17) | 744* (2.15*) | ND (ND) |
| N52H/C140del/T225A | 372 | ND (ND) | 154 (8.56) | 522* (1.51*) | ND (ND) |
| N52H/C198R/T225A | 117 | 1.41 (1.64) | 344 (19.11) | 778* (2.25*) | 0 (0) |
| N52H/K92R | 118 | 1.48 (1.72) | 347 (19.28) | 288* (0.83*) | 89 (0.13) |
| N52H/S99G | 119 | 0.09 (0.10) | 29 (1.61) | 184* (0.53*) | 421 (0.61) |
| N52Y | 120 | 0.08 (0.09) | 18 (1.00) | 184* (0.53*) | 568 (0.83) |
| N57Y | 121 | 1.40 (1.63) | 101 (5.61) | 580* (1.68*) | 176 (0.26) |
| N57Y/Q100P | 122 | 0.62 (0.72) | 285 (15.83) | 301* (0.87*) | 177 (0.26) |
| N52S/S130G/Y152C | 123 | 0.16 (0.19) | 24 (1.33) | 266* (0.77*) | 1617 (2.35) |
| N52S/Y152C | 124 | 0.18 (0.21) | 29 (1.61) | 238* (0.69*) | 363 (0.53) |
| N52S/C198R | 125 | 1.80 (2.09) | 82 (4.56) | 1427 (2.06) | 201 (0.29) |
| N52Y/N57Y/Y152C | 126 | 0.08 (0.09) | 56 (3.11) | 377* (1.09*) | 439 (0.64) |
| N52Y/N57Y/H129P/C198R | 127 | ND (ND) | 449 (24.94) | 1192 (1.72) | ND (ND) |
| N52H/L161P/C198R | 128 | 0.18 (0.21) | 343 (19.05) | 643* (1.86*) | 447 (0.65) |
| N52S/T113E | 129 | 1.51 (1.76) | 54 (3.00) | 451* (1.30*) | 345 (0.50) |
| S54A | 130 | 1.62 (1.88) | 48 (2.67) | 386* (1.12*) | 771 (1.12) |
| N52D/S54P | 368 | 1.50 (1.74) | 38 (2.11) | 476* (1.38*) | 227 (0.33) |
| S54F/V193A | 905 | 0.51 (0.59) | 16 (0.87) | 294 (0.85) | 262 (0.38) |
| N52K/L208P | 132 | 1.91 (2.22) | 291 (16.17) | 1509 (2.18) | 137 (0.20) |
| N52S/Y152H | 133 | 0.85 (0.99) | 68 (3.78) | 2158 (3.12) | 221 (0.32) |
| N52D/V151A | 134 | 0.90 (1.05) | 19 (1.06) | 341* (0.99*) | 450 (0.66) |
| N52H/I143T | 135 | 1.83 (2.13) | 350 (19.44) | 2216 (3.20) | 112 (0.16) |
| N52S/L80P | 136 | 0.09 (0.10) | 22 (1.22) | 192* (0.55*) | 340 (0.49) |

TABLE 7-continued

ICOSL variants selected against CD28 or ICOS. Molecule sequences, binding data, and costimulatory bioactivity data.

| ICOSL mutation(s) | SEQ ID NO (ECD) | Binding | | Coimmobilization with anti-CD3 IFN-gamma | MLR IFN-gamma |
| --- | --- | --- | --- | --- | --- |
| | | ICOS OD (parental ratio) | CD28 MFI (parental ratio) | pg/mL (parental ratio) | levels pg/mL (parental ratio) |
| F120S/Y152H/N201S | 137 | 0.63 (0.73) | 16 (0.89) | 351* (1.01*) | 712 (1.04) |
| N52S/R75Q/L203P | 138 | 1.71 (1.99) | 12 (0.67) | 1996 (2.88) | 136 (0.20) |
| N52S/D158G | 139 | 1.33 (1.55) | 39 (2.17) | 325* (0.94*) | 277 (0.40) |
| N52D/Q133H | 140 | 1.53 (1.78) | 104 (5.78) | 365* (1.05*) | 178 (0.26) |
| WT ICOSL | 32 | 0.86 (1.00) | 18 (1.00) | 692/346* (1.00) | 687 (1.00) |

*Parental ratio calculated using 346 pg/mL IFN-gamma for WT ICOSL

Binding assays were repeated substantially as described above, except that binding also was assessed against cells expressing full-length human CTLA4. ICOSL variant Fc fusion proteins also were further assessed in an anti-CD3 coimmobilization assay substantially as described above. The results confirmed identification of a number of ICOSL IgSF domain variants that exhibited increased binding affinity for at least one, and in some cases more than one, cognate ligand. In addition, the results showed that affinity modification of the variant molecules also exhibited improved activities in the coimmobilization assay.

Example 7

Additional Affinity Modified IgSF Domains

This examples describe the design, creation, and screening of additional affinity modified CD80 (B7-1), CD86 (B7-2) and NKp30 immunomodulatory proteins, which are other components of the immune synapse (IS) that have a demonstrated dual role in both immune activation and inhibition. These examples demonstrate that affinity modification of IgSF domains yields proteins that can act to both increase and decrease immunological activity. This work also describes the various combinations of those domains fused in pairs (i.e., stacked) with a variant affinity modified ICOSL to form a Type II immunomodulatory protein to achieve immunomodulatory activity.

Mutant DNA constructs of human CD80, CD86 and NKp30 IgSF domains for translation and expression as yeast display libraries were generated substantially as described in Example 1. For libraries that target specific residues of target protein for complete or partial randomization with degenerate codons, the coding DNA's for the extracellular domains (ECD) of human CD80 (SEQ ID NO:28), and NKp30 (SEQ ID NO:54) were ordered from Integrated DNA Technologies (Coralville, Iowa) as a set of overlapping oligonucleotides of up to 80 base pairs (bp) in length. Alternatively, residues were mutated by site-directed targeted mutagenesis substantially as described in Example 1. Alternatively, random libraries were constructed to identify variants of the ECD of CD80 (SEQ ID NO:28), CD86 (SEQ ID NO: 29) and NKp30 (SEQ ID NO:54) substantially as described in Example 1.

The targeted and random library DNA was introduced into yeast substantially as described in Example 2 to generate yeast libraries. The libraries were used to select yeast expressing affinity modified variants of CD80, CD86 and NKp30 substantially as described in Example 3. Cells were processed to reduce non-binders and to enrich for CD80, CD86 or NKp30 variants with the ability to bind their exogenous recombinant counter-structure proteins substantially as described in Example 3. For example, yeast displayed targeted or random CD80 libraries were selected against each of CD28, CTL-4, and PD-L1, separately. This was then followed by two to three rounds of flow cytometry sorting using exogenous counter-structure protein staining to enrich the fraction of yeast cells that displays improved binders. Magnetic bead enrichment and selections by flow cytometry are essentially as described in Keith D. Miller, 1 Noah B. Pefaur, 2 and Cheryl L. Baird1 Current Protocols in Cytometry 4.7.1-4.7.30, July 2008.

With CD80, CD86 and NKp30 libraries, target ligand proteins were sourced from R&D Systems (USA) as follows: human rCD28.Fc (i.e., recombinant CD28-Fc fusion protein), rPDL1.Fc, rCTLA4.Fc, and rB7H6.Fc. Two-color flow cytometry was performed substantially as described in Example 3. Yeast outputs from the flow cytometric sorts were assayed for higher specific binding affinity. Sort output yeast were expanded and re-induced to express the particular IgSF affinity modified domain variants they encode. This population then can be compared to the parental, wild-type yeast strain, or any other selected outputs, such as the bead output yeast population, by flow cytometry.

In the case of NKp30 yeast variants selected for binding to B7-H6, the F2 sort outputs gave MFI values of 533 when stained with 16.6 nM rB7H6.Fc, whereas the parental NKp30 strain MFI was measured at 90 when stained with the same concentration of rB7H6.Fc (6-fold improvement).

Among the NKp30 variants that were identified, was a variant that contained mutations L30V/A60V/S64P/S86G with reference to positions in the NKp30 extracellular domain corresponding to positions set forth in SEQ ID NO:54. Among the CD86 variants that were identified, was a variant that contained mutations Q35H/H90L/Q102H with reference to positions in the CD86 extracellular domain corresponding to positions set forth in SEQ ID NO: 29. Among the CD80 variants that were identified, were variants set forth in Table 8 and described further below.

As with ICOSL, the MFIs of all F2 outputs described above when measured with the anti-HA tag antibody on FL1 did not increase and sometimes went down compared to wild-type strains, indicating that increased binding was not a function of increased expression of the selected variants on the surface of yeast, and validated gating strategies of only selecting mid to low expressors with high ligand binding.

Exemplary selection outputs were reformatted as immunomodulatory proteins containing an affinity modified (variant) extracellular domain (ECD) of CD80 fused to an Fc molecule (variant ECD-Fc fusion molecules) substantially as described in Example 4 and the Fc-fusion protein was expressed and purified substantially as described in Example 5.

Binding of exemplary CD80 Fc-fusion variants to cell-expressed counter structures was then assessed substantially as described in Example 6. To produce cells expressing cognate binding partners, full-length mammalian surface expression constructs for each of human CD28, CTLA4 and PD-L1 were produced substantially as described in Example 6. Binding studies and flow cytometry were carried out substantially as described in Example 6. In addition, the bioactivity of the Fc-fusion variant protein was characterized by either mixed lymphocyte reaction (MLR) or anti-CD3 coimmobilization assay substantially as described in Example 6.

Results for the binding and activity studies for exemplary tested variants are shown in Tables 8 and 9. In particular, Table 8 indicates exemplary IgSF domain amino acid substitutions (replacements) in the ECD of CD80 selected in the screen for affinity-maturation against the respective cognate structure CD28. Table 9 indicates exemplary IgSF domain amino acid substitutions (replacements) in the ECD of CD80 selected in the screen for affinity-maturation against the respective cognate structure PD-L1. As above, for each Table, the exemplary amino acid substitutions are designated by amino acid position number corresponding to the respective reference (e.g., unmodified) ECD sequence as follows. For example, the reference (e.g., unmodified) ECD sequence in Tables 8 and 9 is the unmodified CD80 ECD sequence set forth in SEQ ID NO:28. The amino acid position is indicated in the middle, with the corresponding reference (e.g., unmodified) amino acid listed before the number and the identified variant amino acid substitution listed after the number. Column 2 sets forth the SEQ ID NO identifier for the variant ECD for each variant ECD-Fc fusion molecule.

Also shown is the binding activity as measured by the Mean Fluorescence Intensity (MFI) value for binding of each variant Fc-fusion molecule to cells engineered to express the cognate counter structure ligand and the ratio of the MFI compared to the binding of the corresponding reference (e.g., unmodified) ECD-Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/mL) generated either i) with the indicated variant ECD-Fc fusion molecule coimmoblized with anti-CD3 or ii) with the indicated variant ECD-Fc fusion molecule in an MLR assay. The Tables also depict the ratio of IFN-gamma produced by each variant ECD-Fc compared to the corresponding reference (e.g., unmodified) ECD-Fc in both functional assays.

As shown, the selections resulted in the identification of a number of CD80 IgSF domain variants that were affinity-modified to exhibit increased binding for at least one, and in some cases more than one, cognate counter structure ligand. In addition, the results showed that affinity modification of the variant molecules also exhibited improved activities to both increase and decrease immunological activity depending on the format of the molecule. For example, coimmobilization of the ligand likely provides a multivalent interaction with the cell to cluster or increase the avidity to favor agonist activity and increase T cell activation compared to the reference (e.g. unmodified or wildtype) ECD-Fc molecule not containing the amino acid replacement(s). However, when the molecule is provided as a bivalent Fc molecule in solution, the same IgSF domain variants exhibited an antagonist activity to decrease T cell activation compared to the reference (e.g. unmodified or wildtype) ECD-Fc molecule not containing the amino acid replacement(s).

TABLE 8

CD80 variants selected against CD28. Molecule sequences, binding data, and costimulatory bioactivity data.

| | | Binding | | | Coimmobilization with anti-CD3 IFN- | MLR IFN-gamma |
|---|---|---|---|---|---|---|
| CD80 mutation(s) | SEQ ID NO (ECD) | CD28 MFI (parental ratio) | CTLA-4 MFI (parental ratio) | PD-L1 MFI (parental ratio) | gamma pg/mL (parental ratio) | levels pg/mL (parental ratio) |
| L70Q/A91G/N144D | 508 | 125 (1.31) | 283 (1.36) | 6 (0.08) | 93 (1.12) | 716 (0.83) |
| L70Q/A91G/T130A | 56 | 96 (1.01) | 234 (1.13) | 7 (0.10) | 99 (1.19) | 752 (0.87) |
| L70Q/A91G/I118A/T120S/T130A/K169E | 59 | 123 (1.29) | 226 (1.09) | 7 (0.10) | 86 (1.03) | 741 (0.86) |
| V4M/L70Q/A91G/I118V/T120S/T130A/K169E | 510 | 89 (0.94) | 263 (1.26) | 6 (0.09) | 139 (1.67) | 991 (1.14) |
| L70Q/A91G/I118V/T120S/T130A/K169E | 59 | 106 (1.12) | 263 (1.26) | 6 (0.09) | 104 (1.25) | 741 (0.86) |
| V20L/L70Q/A91S/I118V/T120S/T130A | 513 | 105 (1.11) | 200 (0.96) | 9 (0.13) | 195 (2.34) | 710 (0.82) |
| S44P/L70Q/A91G/T130A | 61 | 88 (0.92) | 134 (0.64) | 5 (0.07) | 142 (1.71) | 854 (0.99) |

TABLE 8-continued

CD80 variants selected against CD28. Molecule sequences, binding data, and costimulatory bioactivity data.

| CD80 mutation(s) | SEQ ID NO (ECD) | Binding | | | Coimmobilization with anti-CD3 IFN-gamma pg/mL (parental ratio) | MLR IFN-gamma levels pg/mL (parental ratio) |
|---|---|---|---|---|---|---|
| | | CD28 MFI (parental ratio) | CTLA-4 MFI (parental ratio) | PD-L1 MFI (parental ratio) | | |
| L70Q/A91G/E117G/ I118V/T120S/T130A | 514 | 120 (1.27) | 193 (0.93) | 6 (0.08) | 98 (1.05) | 736 (0.85) |
| A91G/I118V/T120S/T130A | 515 | 84 (0.89) | 231 (1.11) | 44 (0.62) | 276 (3.33) | 714 (0.82) |
| L70R/A91G/I118V/ T120S/T130A/T199S | 516 | 125 (1.32) | 227 (1.09) | 6 (0.09) | 105 (1.26) | 702 (0.81) |
| L70Q/E81A/A91G/I118V/ T120S/I127T/T130A | 517 | 140 (1.48) | 185 (0.89) | 18 (0.25) | 98 (1.18) | 772 (0.89) |
| L70Q/Y87N/A91G/T130A | 66 | 108 (1.13) | 181 (0.87) | 6 (0.08) | 136 (1.63) | 769 (0.89) |
| T28S/L70Q/A91G/I118V/E95K/ T120S/I126V/T130A/K169E | 518 | 32 (0.34) | 65 (0.31) | 6 (0.08) | 120 (1.44) | 834 (0.96) |
| N63S/L70Q/A91G/S114T/ I118V/T120S/T130A | 519 | 124 (1.30) | 165 (0.79) | 6 (0.08) | 116 (1.39) | 705 (0.81) |
| K36E/I67T/L70Q/A91G/ I118V/T120S/T130A/N152T | 520 | 8 (0.09) | 21 (0.10) | 5 (0.08) | 53 (0.63) | 852 (0.98) |
| E52G/L70Q/A91G/ D107N/I118V/ T120S/T130A K169E | 521 | 113 (1.19) | 245 (1.18) | 6 (0.08) | 94 (1.13) | 874 (1.01) |
| K37E/F59S/L70Q/A91G/ I118V/T120S/T130A/K185E | 522 | 20 (0.21) | 74 (0.36) | 6 (0.08) | 109 (1.31) | 863 (1.00) |
| A91G/S103P | 72 | 39 (0.41) | 56 (0.27) | 9 (0.13) | 124 (1.49) | 670 (0.77) |
| K89E/T130A | 73 | 90 (0.95) | 148 (0.71) | 75 (1.07) | 204 (2.45) | 761 (0.88) |
| A91G | 74 | 96 (1.01) | 200 (0.96) | 85 (1.21) | 220 (2.65) | 877 (1.01) |
| D60V/A91G/I118V/ T120S/T130A/K169E | 523 | 111 (1.17) | 222 (1.07) | 12 (0.18) | 120 (1.44) | 744 (0.86) |
| K54M/L70Q/A91G/Y164H | 524 | 68 (0.71) | 131 (0.63) | 5 (0.08) | 152 (1.83) | 685 (0.79) |
| M38T/L70Q/E77G/A91G/ I118V/T120S/T130A/N152T | 525 | 61 (0.64) | 102 (0.49) | 5 (0.07) | 119 (1.43) | 796 (0.92) |
| R29H/E52G/L70R/ E88G/A91G/T130A | 78 | 100 (1.05) | 119 (0.57) | 5 (0.08) | 200 (2.41) | 740 (0.85) |
| Y31H/T41G/M43L/L70Q/A91G/ I118V/T120S/I126V/T130A | 526 | 85 (0.89) | 85 (0.41) | 6 (0.08) | 288 (3.47) | 782 (0.90) |
| V68A/T110A | 80 | 103 (1.08) | 233 (1.12) | 48 (0.68) | 163 (1.96) | 861 (0.99) |
| L65H/D90G/T110A/F116L | 527 | 33 (0.35) | 121 (0.58) | 11 (0.15) | 129 (1.55) | 758 (0.88) |
| R29H/E52G/D90N/ I118V/T120S/T130A | 82 | 66 (0.69) | 141 (0.68) | 11 (0.15) | 124 (1.49) | 800 (0.92) |
| A91G/L102S | 83 | 6 (0.06) | 6 (0.03) | 5 (0.08) | 75 (0.90) | 698 (0.81) |
| I67T/L70Q/A91G/ I118V T120S | 530 | 98 (1.03) | 160 (0.77) | 5 (0.08) | 1751 (21.1) | 794 (0.92) |
| L70Q/A91G/T110A/ I118V/T120S/T130A | 531 | 8 (0.09) | 14 (0.07) | 5 (0.07) | 77 (0.93) | 656 (0.76) |
| M38V/T41D/M43I/ W50G/D76G/V83A/K89E/ I118V/T120S/I126V/T130A | 532 | 5 (0.06) | 8 (0.04) | 8 (0.11) | 82 (0.99) | 671 (0.78) |
| V22A/L70Q/S121P | 87 | 5 (0.06) | 7 (0.04) | 5 (0.07) | 105 (1.27) | 976 (1.13) |
| A12V/S15F/Y31H/M38L/ T41G/M43L/D90N/T130A/ P137L/N149D/N152T | 533 | 6 (0.06) | 6 (0.03) | 5 (0.08) | 104 (1.25) | 711 (0.82) |
| I67F/L70R/E88G/ A91G/I118V/T120S/T130A | 534 | 5 (0.05) | 6 (0.03) | 6 (0.08) | 62 (0.74) | 1003 (1.16) |
| E24G/L25P/L70Q/A91G/ I118V/T120S/N152T | 535 | 26 (0.27) | 38 (0.18) | 8 (0.11) | 101 (1.21) | 969 (1.12) |
| A91G/F92L/F108L/ I118V/T120S | 536 | 50 (0.53) | 128 (0.61) | 16 (0.11) | 59 (0.71) | 665 (0.77) |
| WT CD80 | 28 | 95 (1.00) | 208 (1.00) | 70 (1.00) | 83 (1.00) | 866 (1.00) |

TABLE 9

CD80 variants selected against PD-L1. Molecule sequences, binding data, and costimulatory bioactivity data.

| CD80 mutation(s) | SEQ ID NO (ECD) | Binding | | | Coimmobilization with anti-CD3 IFN-gamma pg/mL (parental ratio) | MLR IFN-gamma levels pg/mL (parental ratio) |
|---|---|---|---|---|---|---|
| | | CD28 MFI (parental ratio) | CTLA-4 MFI (parental ratio) | PD-L1 MFI (parental ratio) | | |
| R29D/Y31L/Q33H/ K36G/M38I/T41A/ M43R/M47T/E81V/ L85R/K89N/A91T/ F92P/K93V/R94L/ I118T/N149S | 92 | 1071 (0.08) | 1089 (0.02) | 37245 (2.09) | 387 (0.76) | 5028 (0.26) |
| R29D/Y31L/Q33H/ K36G/M38I/T41A/ M43R/M47T/E81V/ L85R/K89N/A91T/ F92P/K93V/R94L/ N144S/N149S | 93 | 1065 (0.08) | 956 (0.02) | 30713 (1.72) | 400 (0.79) | 7943 (0.41) |
| R29D/Y31L/Q33H/ K36G/M38I/T41A/ M42T/M43R/M47T/ E81V/L85R/K89N/ A91T/F92P/K93V/ R94L/L148S/N149S | 94 | 926 (0.07) | 954 (0.02) | 47072 (2.64) | 464 (0.91) | 17387 (0.91) |
| E24G/R29D/Y31L/ Q33H/K36G/M38I/ T41A/M43R/M47T/ F59L/E81V/L85R/ K89N/A91T/F92P/ K93V/R94L/H96R | 95 | 1074 (0.08) | 1022 (0.02) | 1121 (0.06) | 406 (0.80) | 13146 (0.69) |
| R29D/Y31L/Q33H/ K36G/M38I/T41A/ M43R/M47T/E81V/ L85R/K89N/A91T/ F92P/K93V/R94L/N149S | 96 | 1018 (0.08) | 974 (0.02) | 25434 (1.43) | 405 (0.80) | 24029 (1.25) |
| R29V/M43Q/E81R/ L85I/K89R/D90L/ A91E/F92N/K93Q/R94G | 97 | 1029 (0.08) | 996 (0.02) | 1575 (0.09) | 342 (0.67) | 11695 (0.61) |
| T41I/A91G | 98 | 17890 (1.35) | 50624 (1.01) | 12562 (0.70) | 433 (0.85) | 26052 (1.36) |
| E88D/K89R/ D90K/A91G/F92Y/ K93R/N122S/N178S | 537 | 41687 (3.15) | 49429 (0.99) | 20140 (1.13) | 773 (1.52) | 6345 (0.33) |
| E88D/K89R/D90K/ A91G/F92Y/K93R | 538 | 51663 (3.91) | 72214 (1.44) | 26405 (1.48) | 1125 (2.21) | 9356 (0.49) |
| K36G/K37Q/M38I/ L40M/F59L/E81V/L85R/ K89N/A91T/F92P/ K93V/R94L/E99G/ T130A/N149S | 539 | 1298 (0.10) | 1271 (0.03) | 3126 (0.18) | 507 (1.00) | 3095 (0.16) |
| AE88D/K89R/D90K/ A91G/F92Y/K93R | 102 | 31535 (2.38) | 50868 (1.02) | 29077 (1.63) | 944 (1.85) | 5922 (0.31) |
| K36G/K37Q/ M38I/L40M | 103 | 1170 (0.09) | 1405 (0.03) | 959 (0.05) | 427 (0.84) | 811 (0.04) |
| K36G/L40M | 540 | 29766 (2.25) | 58889 (1.18) | 20143 (1.13) | 699 (1.37) | 30558 (1.59) |
| WTCD80 | 28 | 13224 (1.00) | 50101 (1.00) | 17846 (1.00) | 509 (1.00) | 19211 (1.00) |

Example 8

Generation and Assessment of Stacked Molecules Containing Different Affinity-Modified Domains This Example describes further immunomodulatory proteins that were generated as stack constructs containing at least two different affinity modified domains from identified variant ICOSL polypeptides and one more additional variant CD80, CD86, ICOSL, and NKp30 molecules linked together and fused to an Fe.

Selected variant molecules described above that were affinity-modified for one or more counter structure ligand were used to generate "stack" molecule (i.e., Type II immunomodulatory protein) containing two or more affinity-modified IgSF domains. Stack constructs were obtained as geneblocks (Integrated DNA Technologies, Coralville, Iowa) that encode the stack in a format that enables its fusion to Fc by standard Gibson assembly using a Gibson assembly kit (New England Biolabs, USA).

The encoding nucleic acid molecule of all stacks was generated to encode a protein designed as follows: Signal peptide, followed by the first variant IgV of interest, followed by a 15 amino acid linker which is composed of three GGGGS(G4S) motifs (SEQ ID NO:228), followed by the second IgV of interest, followed by two GGGGS linkers (SEQ ID NO: 229) followed by three alanines (AAA), followed by a human IgG1 Fc as described above. To maximize the chance for correct folding of the IgV domains in each stack, the first IgV was preceded by all residues that normally occur in the wild-type protein between this IgV and the signal peptide (leading sequence). Similarly, the first IgV was followed by all residues that normally connect it in the wild-type protein to either the next Ig domain (typically an IgC domain) or if such a second IgV domain is absent, the residues that connect it to the transmembrane domain (trailing sequence). The same design principle was applied to the second IgV domain except that when both IgV domains were derived from same parental protein (e.g. a ICOSL IgV stacked with another ICOSL IgV), the linker between both was not duplicated.

Table 10 sets forth the design for exemplary stacked constructs. The exemplary stack molecules shown in Table 10 contains the Ig domains (e.g. IgV domain) as indicated and additionally trailing sequences as described above. In the Table, the following components are present in order: signal peptide (SP; SEQ ID NO:225), Ig domain 1 (e.g. Ig1), trailing sequence 1 (TS1), linker 1 (LR1; SEQ ID NO:228), Ig domain 2 (Ig2), trailing sequence 2 (TS2), linker 2 (LR2; SEQ ID NO:230) and Fc domain (SEQ ID NO:226 containing C5S/R77C/N82G/V87C amino acid substitution). In some cases, a leading sequence 1 (LS1) is present between the signal peptide and IgV1 and in some cases a leading sequence 2 (LS2) is present between the linker and IgV2.

TABLE 10

Amino acid sequence (SEQ ID NO) of components of exemplary stacked constructs

| | First domain | | | | Second domain | | | | |
| --- | --- | --- | --- | --- | --- | --- | --- | --- | --- |
| | SP | LS1 | Ig1 | TS1 | LR1 | LS2 | Ig2 | TS2 | LR2 | Fc |
| Domain 1: NKp30 WT Domain 2: ICOSL WT | + | − | 214 | 235 | + | − | 196 | 233 | + | + |
| Domain 1. NKp30 L30V/A60V/ S64P/S86G Domain 2: ICOSL N52S/N57Y/H94D/ L96F/L98F/Q100R | + | − | 215 | 235 | + | − | 212 | 233 | + | + |
| Domain 1. NKp30 L30V/A60V/ S64P/S86G) Domain 2: ICOSL N52D | + | − | 215 | 235 | + | − | 199 | 233 | + | + |
| Domain 1. NKp30 L30V/A60V/ S64P/S86G Domain 2: ICOSL N52H/N57Y/Q100P | + | − | 215 | 235 | + | − | 201 | 233 | + | + |
| Domain 1: ICOSL WT Domain 2: Nkp30 WT | + | − | 196 | 233 | + | − | 214 | 235 | + | + |
| Domain 1: ICOSL N52D Domain 2: NKp30 L30V/A60V/ S64P/S86G | + | − | 199 | 233 | + | − | 215 | 235 | + | + |
| Domain 1: ICOSL N52H/N57Y/Q100P Domain 2. NKp30 L30V/A60V/ S64P/S86G | + | − | 201 | 233 | + | − | 215 | 235 | + | + |
| Domain 1: CD80 WT Domain 2: ICOSL WT | + | − | 152 | 471 | + | − | 196 | 233 | + | + |
| Domain 1: CD80 E88D/K89R/D90K/ A91G/F92Y/K93R Domain 2: ICOSL N52S/N57Y/H94D/ L96F/L98F/Q100R/ G103E/F120S | + | − | 189 | 471 | + | − | 213 | 233 | + | + |
| Domain 1: CD80 A12T/H18L/M43V/ F59L/E77K/ P109S/I118T Domain 2: ICOSL N52S/N57Y/H94D/ L96F/L98F/Q100R/ G103E/F120S | + | − | 193 | 471 | + | − | 213 | 233 | + | + |

TABLE 10-continued

Amino acid sequence (SEQ ID NO) of components of exemplary stacked constructs

| | | First domain | | | | Second domain | | | |
|---|---|---|---|---|---|---|---|---|---|
| | SP | LS1 | Ig1 | TS1 | LR1 | LS2 | Ig2 | TS2 | LR2 | Fc |
| Domain 1: CD80 A12T/H18L/M43V/ F59L/E77K/ P109S/I118T Domain 2: ICOSL N52D | + | − | 193 | 471 | + | − | 199 | 233 | + | + |
| Domain 1: CD80 E88D/K89R/D90K/ A91G/F92Y/K93R Domain 2: ICOSL N52H/N57Y/Q100P | + | − | 189 | 471 | + | − | 201 | 233 | + | + |
| Domain 1: CD80 A12T/H18L/M43V/ F59L/E77K/ P109S/I118T Domain 2: ICOSL N52H/N57Y/Q100P | + | − | 193 | 471 | + | − | 201 | 233 | + | + |
| Domain 1: ICOSL WT Domain 2: CD80 WT | + | − | 196 | 233 | + | − | 152 | 471 | + | + |
| Domain 1: ICOSL N52S/N57Y/H94D/ L96F/L98F/Q100R/ G103E/F120S Domain 2: CD80 E88D/K89R/D90K/ A91G/F92Y/K93R | + | − | 213 | 233 | + | − | 189 | 471 | + | + |
| Domain 1: ICOSL N52S/N57Y/H94D/ L96F/L98F/Q100R/ G103E/F120S Domain 2: CD80 A12T/H18L/M43V/ F59L/E77K/ P109S/I118T | + | − | 213 | 233 | + | − | 193 | 471 | + | + |
| Domain 1: ICOSL N52D Domain 2: CD80 E88D/K89R/D90K/ A91G/F92Y/K93R | + | − | 199 | 233 | + | − | 189 | 471 | + | + |
| Domain 1: ICOSL N52D Domain 2: CD80 A12T/H18L/M43V/ F59L/E77K/ P109S/I118T | + | − | 199 | 233 | + | − | 193 | 471 | + | + |
| Domain 1: ICOSL N52H/N57Y/Q100P Domain 2: CD80 E88D/K89R/D90K/ A91G/F92Y/K93R | + | − | 201 | 233 | + | − | 189 | 471 | + | + |
| Domain 1: ICOSL N52H/N57Y/Q100P Domain 2: CD80 A12T/H18L/M43V/ F59L/E77K/ P109S/I118T | + | − | 201 | 233 | + | − | 193 | 471 | + | + |
| Domain 1: CD86 WT Domain 2: ICOSL WT | + | 236 | 220 | 237 | + | − | 196 | 233 | + | + |
| Domain 1: CD80 R29H/Y31H/T41G/ Y87N/E88G/K89E/ D90N/A91G/P109S Domain 2: ICOSL N52S/N57Y/H94D/ L96F/L98F/Q100R/ G103E/F120S | + | − | 192 | 471 | + | − | 213 | 233 | + | + |

TABLE 10-continued

Amino acid sequence (SEQ ID NO) of components of exemplary stacked constructs

| | First domain | | | | | Second domain | | | | |
|---|---|---|---|---|---|---|---|---|---|---|
| | SP | LS1 | Ig1 | TS1 | LR1 | LS2 | Ig2 | TS2 | LR2 | Fc |
| Domain 1: CD80 I67T/L70Q/ A91G/T120S Domain 2: ICOSL N52S/N57Y/H94D/ L96F/L98F/Q100R/ G103E/F120S | + | – | 175 | 471 | + | – | 213 | 233 | + | + |
| Domain 1: CD80 R29H/Y31H/T41G/ Y87N/E88G/K89E/ D90N/A91G/P109S Domain 2: ICOSL N52D | + | – | 192 | 471 | + | – | 199 | 233 | + | + |
| Domain 1: CD80 I67T/L70Q/ A91G/T120S Domain 2: ICOSL N52D | + | – | 175 | 471 | + | – | 199 | 233 | + | + |
| Domain 1: CD80 R29H/Y31H/T41G/ Y87N/E88G/K89E/ D90N/A91G/P109S Domain 2: ICOSL N52H/N57Y/Q100P | + | – | 192 | 471 | + | – | 201 | 233 | + | + |
| Domain 1: CD80 I67T/L70Q/ A91G/T120S Domain 2: ICOSL N52H/N57Y/Q100P | + | – | 175 | 471 | + | – | 201 | 233 | + | + |
| Domain 1: CD86 Q35H/H90L/Q102H Domain 2: ICOSL N52S/N57Y/H94D/ L96F/L98F/Q100R/ G103E/F120S | + | 236 | 221 | 237 | + | – | 213 | 233 | + | + |
| Domain 1: CD86 Q35H/H90L/Q102H Domain 2: ICOSL N52D | + | 236 | 221 | 237 | + | – | 199 | 233 | + | + |
| Domain 1: CD86 Q35H/H90L/Q102H Domain 2: ICOSL N52H/N57Y/Q100P | + | 236 | 221 | 237 | + | – | 201 | 233 | + | + |
| Domain 1: ICOSL WT Domain 2: CD86 WT | + | – | 196 | 233 | + | 236 | 220 | 237 | + | + |
| Domain 1: ICOSL N52S/N57Y/H94D/ L96F/L98F/Q100R/ G103E/F120S Domain 2: CD80 R29H/Y31H/T41G/ Y87N/E88G/K89E/ D90N/A91G/P109S | + | – | 213 | 233 | + | – | 192 | 471 | + | + |
| Domain 1: ICOSL N52S/N57Y/H94D/ L96F/L98F/Q100R/ G103E/F120S Domain 2: CD80 I67T/L70Q/ A91G/T120S | + | – | 213 | 233 | + | – | 175 | 471 | + | + |
| Domain 1: ICOSL N52D Domain 2: CD80 R29H/Y31H/T41G/ Y87N/E88G/K89E/ D90N/A91G/P109S | + | – | 199 | 233 | + | – | 192 | 471 | + | + |
| Domain 1: ICOSL N52D Domain 2: CD80 I67T/L70Q/ A91G/T120S | + | – | 199 | 233 | + | – | 175 | 471 | + | + |

TABLE 10-continued

Amino acid sequence (SEQ ID NO) of components of exemplary stacked constructs

| | | First domain | | | | Second domain | | | | |
|---|---|---|---|---|---|---|---|---|---|---|
| | SP | LS1 | Ig1 | TS1 | LR1 | LS2 | Ig2 | TS2 | LR2 | Fc |
| Domain 1: ICOSL N52H/N57Y/Q100P Domain 2: CD80 R29H/Y31H/T41G/ Y87N/E88G/K89E/ D90N/A91G/P109S | + | – | 201 | 233 | + | – | 192 | 471 | + | + |
| Domain 1: ICOSL N52S/N57Y/H94D/ L96F/L98F/Q100R/ G103E/F120S Domain 2: CD86 Q35H/H90L/Q102H | + | – | 213 | 233 | + | 236 | 221 | 237 | + | + |
| Domain 1: ICOSL N52D Domain 2: CD86 Q35H/H90L/Q102H | + | – | 199 | 233 | + | 236 | 221 | 237 | + | + |
| Domain 1: ICOSL N52H/N57Y/Q100P Domain 2: CD86 Q35H/H90L/Q102H | + | – | 201 | 233 | + | 236 | 221 | 237 | + | + |

High throughput expression and purification of the variant IgV-stacked-Fc fusion molecules containing various combinations of variant IgV domains from CD80, CD86, ICOSL or Nkp30 containing at least one affinity-modified IgV domain were generated substantially as described in Example 5. Binding of the variant IgV-stacked-Fc fusion molecules to respective counter structures and functional activity by anti-CD3 coimmobilization assay also were assessed substantially as described in Example 6. For example, costimulatory bioactivity of the stacked IgSF Fc fusion proteins was determined in a similar immobilized anti-CD3 assay as above. In this case, 4 nM of anti-CD3 (OKT3, Biolegend, USA) was coimmobilized with 4 nM to 120 nM of human rB7-H6.Fc (R&D Systems, USA) or human rPD-L1.Fc (R&D Systems, USA) overnight on tissue-culture treated 96-well plates (Corning, USA). The following day unbound protein was washed off with PBS and 100,000 purified pan T cells were added to each well in 100 μl Ex-Vivo 15 media (Lonza, Switzerland). The stacked IgSF domains were subsequently added at concentrations ranging from 8 nM to 40 nM in a volume of 100 μl for 200 μl volume total. Cells were cultured 3 days before harvesting culture supernatants and measuring human IFN-gamma levels with Duoset ELISA kit (R&D Systems, USA) as mentioned above.

The results are set forth in Tables 11-13. Specifically, Table 11 sets forth binding and functional activity results for variant IgV-stacked-Fc fusion molecules containing an NKp30 IgV domain and an ICOSL IgV domain. Table 12 and 13 sets forth binding and functional activity results for variant IgV-stacked-Fc fusion molecules containing a variant ICOSL IgV domain and a variant CD80 IgV or CD86 IgV domain.

For each of Tables 11-13, Column 1 indicates the structural organization and orientation of the stacked, affinity modified or wild-type (WT) domains beginning with the amino terminal (N terminal) domain, followed by the middle WT or affinity modified domain located before the C terminal human IgG1 Fc domains. Column 2 sets forth the SEQ ID NO identifier for the sequence of each IgV domain contained in a respective "stack" molecule. Column 3 shows the binding partners which the indicated affinity modified stacked domains from column 1 were selected against.

Also shown is the binding activity as measured by the Mean Fluorescence Intensity (MFI) value for binding of each stack molecule to cells transfected to express various counter structure ligands and the ratio of the MFI compared to the binding of the corresponding stack molecule containing reference (e.g., unmodified) IgV domains not containing the amino acid substitution(s) to the same cell-expressed counter structure ligand. The functional activity of the variant stack molecules to modulate the activity of T cells also is shown based on the calculated levels of IFN-gamma in culture supernatants (pg/mL) generated with the indicated variant stack molecule in solution and the appropriate ligand coimmoblized with anti-CD3 as described in Example 6. The Table also depicts the ratio of IFN-gamma produced by each variant stack molecule compared to the corresponding reference (e.g., unmodified) stack molecule in the coimmobilization assay.

As shown, the results showed that it was possible to generate stack molecules containing at least one variant IgSF domains that exhibited affinity-modified activity of increased binding for at least one cognate counter structure ligand compared to a corresponding stack molecule containing the respective reference (e.g. wild-type or unmodified) IgV domain. In some cases, the stack molecule, either from one or a combination of both variant IgSF domains in the molecule, exhibited increased binding for more than one cognate counter structure ligand. The results also showed that the order of the IgV domains in the stacked molecules could, in some cases, alter the degree of improved binding activity. In some cases, functional T cell activity also was altered when assessed in the targeted coimmobilization assay.

TABLE 11

Stacked variant IgV Fc fusion proteins containing an NKp30 IgV domain and an ICOSL IgV domain

| Domain Structure N terminal to C terminal: domain 1/domain 2/Fc | SEQ ID NO (Ig domain) | Counter structure selected against | Binding Activity B7H6 MFI (WT parental MFI ratio) | Binding Activity ICOS MFI (WT parental MFI ratio) | Binding Activity CD28 MFI (WT parental MFI ratio) | Anti-CD3 coimmobilization assay pg/mL IFN-gamma (WT parental IFN-gamma ratio) |
|---|---|---|---|---|---|---|
| Domain 1. NKp30 WT | 214 | — | 64538 | 26235 | 6337 | 235 |
| Domain 2 ICOSL WT | 196 | | (1.00) | (1.00) | (1.00) | (1.00) |
| Domain1. NKp30 L30V/A60V/S64P/S86G | 215 | B7-H6 | 59684 (0.92) | 12762 (0.49) | 9775 (1.54) | 214 (0.91) |
| Domain 2. ICOSL N52S N57Y H94D L96F L98F Q100R | 212 | ICOS-CD28 | | | | |
| Domain 1. NKp30 L30V/A60V/S64P/S86G | 215 | B7-H6 | 65470 (1.01) | 30272 (1.15) | 9505 (1.50) | 219 (0.93) |
| Domain 2. ICOSL N52D | 199 | ICOS-CD28 | | | | |
| Domain 1. NKp30 L30V/A60V/S64P/S86G | 215 | B7-H6 | 38153 (0.59) | 27903 (1.06) | 11300 (1.78) | 189 (0.80) |
| Domain 2. ICOSL N52H N57Y Q100P | 201 | ICOS-CD28 | | | | |
| Domain 1. ICOSL WT | 196 | — | 117853 | 70320 | 7916 | 231 |
| Domain 2. Nkp30 WT | 214 | | (1.0) | (1.0) | (1.0) | (1.0) |
| Domain 1: ICOSL N52D | 199 | ICOS-CD28 | 100396 (0.85) | 83912 (1.19) | 20778 (2.62) | 228 (0.98) |
| Domain 2. NKp30 L30V/A60V/S64P/S86G | 215 | B7-H6 | | | | |
| Domain 1. ICOSL N52H/N57Y/Q100P | 201 | ICOS-CD28 | 82792 (0.70) | 68874 (0.98) | 72269 (9.12) | 561 (2.43) |
| Domain 2. NKp30 L30V/A60V/S64P/S86G | 215 | B7-H6 | | | | |

TABLE 12

Stacked variant IgV Fc fusion proteins containing a CD80 IgV domain and an ICOSL IgV domain

| Domain Structure N terminal to C terminal: domain 1/domain 2/Fc | SEQ ID NO (Ig domain) | Counter structure selected against | Binding Activity CD28 MFI (WT parental MFI ratio) | Binding Activity PD-L1 MFI (WT parental MFI ratio) | Binding Activity ICOS MFI (WT parental MFI ratio) | Anti-CD3 coimmobilization assay pg/mL IFN-gamma (WT parental IFN-gamma ratio) |
|---|---|---|---|---|---|---|
| Domain 1. CD80 WT | 152 | | 1230 | 2657 | 11122 | 69 |
| Domain 2. ICOSL WT | 196 | | (1.00) | (1.00) | (1.00) | (1.00) |
| Domain 1. CD80 E88D/K89R/D90K/A91G/F92Y/K93R | 189 | PD-Ll | 3383 (2.75) | 4515 (1.70) | 5158 (0.46) | 90 (1.30) |
| Domain 2. ICOSL N52S/N57Y/H94D/L96F/L98F/Q100R/G103E/F120S | 213 | ICOS/CD28 | | | | |
| Domain 1. CD80 A12T/H18L/M43V/F59L/E77K/P109S/I118T | 193 | PD-L1 | 2230 (1.81) | 2148 (0.81) | 3860 (0.35) | 112 (1.62) |
| Domain 2. ICOSL N52S/N57Y/H94D/L96F/L98F/Q100R/G103E/F120S | 213 | ICOS/CD28 | | | | |
| Domain 1. CD80 A12T/H18L/M43V/F59L/E77K/P109S/I118T | 193 | PD-L1 | 5665 (4.61) | 6446 (2.43) | 15730 (1.41) | 126 (1.83) |
| Domain 2. ICOSL N52D | 199 | ICOS/CD28 | | | | |
| Domain 1. CD80 E88D/K89R/D90K/A91G/F92Y/K93R | 189 | PD-L1 | 6260 (5.09) | 4543 (1.71) | 11995 (1.08) | 269 (3.90) |

TABLE 12-continued

Stacked variant IgV Fc fusion proteins containing a CD80 IgV domain and an ICOSL IgV domain

|

TABLE 13-continued

Stacked variant IgV Fc fusion proteins containing
a CD80 or CD86 IgV domain and an ICOSL IgV domain

| Domain Structure N terminal to C terminal: domain 1/domain 2/Fc | SEQ ID NO (Ig domain) | Counter structure selected against | Binding Activity PD-L1 MFI (WT parental MFI ratio) | Binding Activity CTLA-4 MFI (WT parental MFI ratio) | Functional Activity MLR IFN-gamma pg/mL |
|---|---|---|---|---|---|
| Domain 1: CD80 I67T/L70Q/A91G/T120S | 175 | CD28 | 2309 (1.88) | 26982 (2.43) | 1561 (0.89) |
| Domain 2: ICOSL N52S/N57Y/H94D/L96F/ L98F/Q100R/G103E/F120S | 213 | ICOS/CD28 | | | |
| Domain 1: CD80 R29H/Y31H/T41G/Y87N/ E88G/K89E/D90N/A91G/ P109S | 192 | CD28 | 4285 (3.48) | 22744 (2.04) | 1612 (0.92) |
| Domain 2: ICOSL N52D | 199 | ICOS/CD28 | | | |
| Domain 1: CD80 I67T/L70Q/A91G/T120S | 175 | CD28 | 3024 (2.46) | 16916 (1.52) | 3857 (2.20) |
| Domain 2: ICOSL N52D | 199 | ICOS/CD28 | | | |
| Domain 1: CD80 R29H/Y31H/T41G/Y87N/ E88G/K89E/D90N/A91G/ P109S | 192 | CD28 | 6503 (5.29) | 7240 (0.65) | 6886 (3.92) |
| Domain 2: ICOSL N52H/N57Y/Q100P | 201 | ICOS/CD28 | | | |
| Domain 1: CD80 I67T/L70Q/A91G/T120S | 175 | CD28 | 3110 (2.53) | 4848 (0.44) | 3393 (1.93) |
| Domain 2: ICOSL N52H/N57Y/Q100P | 201 | ICOS/CD28 | | | |
| Domain 1: CD86 Q35H/H90L/Q102H | 221 | CD28 | 11662 (0.40) | 21165 (0.38) | 880 (0.14) |
| Domain 2: ICOSL N52S/N57Y/H94D/L96F/ L98F/Q100R/G103E/F120S | 213 | ICOS/CD28 | | | |
| Domain 1: CD86 Q35H/H90L/Q102H | 221 | CD28 | 24230 (0.83) | 73287 (1.33) | 1110 (0.18) |
| Domain 2: ICOSL N52D | 199 | ICOS/CD28 | | | |
| Domain 1: CD86 Q35H/H90L/Q102H | 221 | CD28 | 1962 (0.07) | 1630 (0.03) | 587 (0.09) |
| Domain 2: ICOSL N52H/N57Y/Q100P | 201 | ICOS/CD28 | | | |
| Domain 1: ICOSL WT | 196 | | 3000 (1.00) | 14366 (1.00) | 4113 (1.00) |
| Domain 2: CD80 WT | 152 | | | | |
| Domain 1: ICOSL WT | 196 | | 18005 (1.00) | 53602 (1.00) | 18393 (1.00) |
| Domain 2: CD86 WT | 220 | | | | |
| Domain 1: ICOSL N52S/N57Y/H94D/L96F/ L98F/Q100R/G103E/F120S | 213 | ICOS/CD28 | 10426 (3.48) | 51286 (3.57) | 18680 (4.54) |
| Domain 2: CD80 R29H/Y31H/T41G/Y87N/ E88G/K89E/D90N/A91G/ P109S | 192 | CD28 | | | |
| Domain 1: ICOSL N52S/N57Y/H94D/L9617 L98F/Q100R/G103E/F120S | 213 | ICOS/CD28 | 17751 (5.92) | 29790 (2.07) | 10637 (2.59) |
| Domain 2: CD80 I67T/L70Q/A91G/T120S | 175 | CD28 | | | |
| Domain 1: ICOSL N52D | 199 | ICOS/CD28 | 2788 (0.93) | 25870 (1.80) | 6205 (1.51) |
| Domain 2: CD80 R29H/Y3IH/T41G/Y87N/ E88G/K89E/D90N/A91G/ P109S | 192 | CD28 | | | |
| Domain 1: ICOSL N52D | 199 | ICOS/CD28 | 2522 (0.84) | 13569 (0.94) | 5447 (1.32) |
| Domain 2: CD80 I67T/L70Q/A91G/T120S | 175 | CD28 | | | |
| Domain 1: ICOSL N52H/N57Y/Q100P | 201 | ICOS/CD28 | 9701 (3.23) | 9187 (0.64) | 5690 (1.38) |
| Domain 2: CD80 R29H/Y31H/T41G/Y87N/ E88G/K89E/D90N/A91G/ P109S | 192 | CD28 | | | |

TABLE 13-continued

Stacked variant IgV Fc fusion proteins containing
a CD80 or CD86 IgV domain and an ICOSL IgV domain

| Domain Structure<br>N terminal to C terminal:<br>domain 1/domain 2/Fc | SEQ ID<br>NO<br>(Ig<br>domain) | Counter<br>structure<br>selected<br>against | Binding Activity | | Functional<br>Activity MLR<br>IFN-gamma<br>pg/mL |
|---|---|---|---|---|---|
| | | | PD-L1 MFI<br>(WT parental<br>MFI ratio) | CTLA-4 MFI<br>(WT parental<br>MFI ratio) | |
| Domain 1: ICOSL<br>N52S/N57Y/H94D/L96F/<br>L98F/Q100R/G103E/F120S | 213 | ICOS/CD28 | 27050<br>(1.50) | 21257<br>(0.40) | 8131<br>(0.44) |
| Domain 2: CD86<br>Q35H/H90L/Q102H | 221 | CD28 | | | |
| Domain 1: ICOSL<br>N52D | 199 | ICOS/CD28 | 34803<br>(1.93) | 80210<br>(1.50) | 6747<br>(0.37) |
| Domain 2: CD86<br>Q35H/H90L/Q102H | 221 | CD28 | | | |
| Domain 1: ICOSL<br>N52H/N57Y/Q100P | 201 | ICOS/CD28 | 5948<br>(0.33) | 4268<br>(0.08) | 26219<br>(1.43) |
| Domain 2: CD86<br>Q35H/H90L/Q102H | 221 | CD28 | | | |

Example 9

Generation and Assessment of Engineered Cells
Expressing a Transmembrane Immunomodulatory
Protein Engineered T cells were generated in which a transmembrane immunomodulatory protein (TIP) containing an extracellular domain (ECD) containing either a variant CD80 as described above or an ICOSL affinity-modified IgSF domain was co-expressed with a chimeric antigen receptor (CAR). The TIP also contained a transmembrane domain and a cytoplasmic domain of the corresponding wild-type CD80 or ICOSL transmembrane protein sequence. The immunomodulatory activity of the engineered cells was compared to cells that only expressed the CAR or cells that co-expressed the corresponding wild-type CD80 or ICOSL transmembrane protein with the CAR.

The exemplary CD80-TIP was a variant CD80 having an affinity-modified IgSF domain containing amino acid mutations in the IgV and IgC domains corresponding to I67T/L70Q/A91G/T120S with reference to positions in the CD80 extracellular domain set forth in SEQ ID NO:28 and a transmembrane and cytoplasmic domain corresponding to residues 243-288 of SEQ ID NO:1. The amino acid sequence of the exemplary CD80-TIP is set forth in SEQ ID NO: 241 and is encoded by the sequence of nucleotides set forth in SEQ ID NO:242. The corresponding wild-type CD80 transmembrane protein had the sequence of amino acids set forth as amino acid residues 35-288 of SEQ ID NO:1 and encoded by the sequence of amino acids set forth in SEQ ID NO: 251.

The exemplary ICOSL-TIP was a variant ICOSL having an affinity-modified IgSF domain containing amino acid mutations in the IgV domain corresponding to N52H/I143T with reference to positions in the ICOSL extracellular domain set forth in SEQ ID NO:32 and a transmembrane and cytoplasmic domain corresponding to residues 257-302 of SEQ ID NO:5. The amino acid sequence of the exemplary ICOSL-TIP is set forth in SEQ ID NO:243 and is encoded by the sequence of nucleotides set forth in SEQ ID NO:244. The corresponding wild-type ICOSL transmembrane protein had the sequence of amino acids set forth as amino acid residues 19-302 of SEQ ID NO:5 and encoded by the sequence of amino acids set forth in SEQ ID NO: 252.

The TIP containing the affinity-modified domain or the wild-type transmembrane protein containing a corresponding non-affinity modified IgSF domain were co-expressed in T cells with a $1^{st}$ generation chimeric antigen receptor (CAR) containing a CD3zeta intracellular signaling domain. The $1^{st}$ generation CAR included an scFv specific for CD19 (SEQ ID NO:245), a hinge and transmembrane domain derived from CD8 (SEQ ID NO:246) and an intracellular signaling domain derived from CD3zeta (set forth in SEQ ID NO:47). The nucleotide sequence encoding the CD19 scFv-CD3zeta CAR is set forth in SEQ ID NO: 248 and the amino acid sequence of the CD19 scFv-CD3zeta CAR is set forth in SEQ ID NO: 479.

Nucleic acid molecules encoding the CAR alone or also encoding one of the exemplary TIPs or wild-type transmembrane proteins separated from the CAR by a self-cleaving T2A sequence (SEQ ID NO:250 and encoded by the sequence of nucleotides set forth in SEQ ID NO:249) were generated. Exemplary constructs contained nucleic acid sequences set forth in Table 14. As a control, a nucleic acid construct encoding a $2^{nd}$ generation CAR additionally containing a CD28 costimulatory domain also was generated (CD19 scFv-CD28-CD3zeta).

TABLE 14

Nucleic Acid Constructs

| | CAR<br>(SEQ ID NO) | T2A Linker<br>(SEQ ID NO) | TIP<br>(SEQ ID NO) |
|---|---|---|---|
| CD19 scFv -<br>CD3zeta | +<br>(248) | − | − |
| CD19 scFv -<br>CD3zeta - T2A -<br>B7-1 | +<br>(248) | +<br>(249) | Wildtype CD80<br>(251) |
| CD19 scFv -<br>CD3zeta - T2A -<br>B7-1_TIP | +<br>(248) | +<br>(249) | CD80 TIP<br>(242) |
| CD19 scFv -<br>CD3zeta - T2A -<br>ICOSL | +<br>(248) | +<br>(249) | Wildtype ICOSL<br>(252) |
| CD19 scFv -<br>CD3zeta - T2A -<br>ICOSL_TIP | +<br>(248) | +<br>(249) | ICOSL TIP<br>(244) |

The nucleic acid molecules were individually cloned into a lentiviral vector, which was used to transduce T cells isolated from human PBMC samples obtained from three different healthy donors. Lentivirus particles containing the nucleic acid sequences were produced after co-transfection of HEK293 cells with the vectors and lentivirus packaging constructs. The lentivirus particles were collected from the culture medium by ultracentrifugation and titered by qRT-PCR. Human peripheral blood mononuclear cells (PBMC) were isolated from three normal blood donors using density sedimentation. The PBMC were cultured overnight with anti-CD3 and anti-CD28 antibodies and IL-2, then transduced with the lentivirus preparations at a multiplicity of infection of 5:1. The lentiviral vectors encoding the control $2^{nd}$ generation CAR was only used to transduce cells from one donor.

After two weeks (14 days) of culture, the cells were analyzed for cytotoxicity following co-culture with target antigen-expressing cells using the Acea Real-Time Cell Analyzer (RTCA), which measures the impedance variations in the culture media of a 96-well microelectronic plate (E-plate), and shows the changes in cell number and morphology in a real-time plot. CD19-expressing HeLa target cells (HeLa-CD19) were seeded into a 96-well E-plate and the impedance of each monolayer was monitored for 24 hours using the RTCA system. The engineered T cells were added to the wells at an effector:target ratio of 10:1 and the wells were monitored for another 48 hours. The results were displayed and recorded as Cell Index (CI) value derived from the change in measured electrical impedance and were then ratio transformed by dividing the CI readouts of all wells at all time points over the CI value of individual wells at a same time (base-time) to obtain a normalized cell index value representing the percentage of the value at the base-time (see Zhang et al. "Introduction to the Data Analysis of the Roche xCELLigence® System with RTCA Package." *Bioconductor*. May 3, 2016, bioconductor.org/packages/devel/bioc/vignettes/RTCA/inst/doc/aboutRTCA.pdf Accessed Sep. 9, 2016). In this assay, a decrease in the impedance of a monolayer reflects killing of the target cells by the transduced cells.

The results showed that decreased impedance was observed in cells expressing the $1^{st}$ generation CAR compared to non-transduced T cells, although the degree of decreased impedance for cells expressing the $1^{st}$ generation CAR was less than cells expressing the $2^{nd}$ generation CAR. The decreased impedance in cells expressing the $1^{st}$ generation CAR continued generally for up to the first 8 hours of the assay, while only the $2^{nd}$ generation CAR-expressing cells continued to decrease the impedance thereafter.

As shown in FIG. 1, in one donor, each of the cells co-expressing the TIP or corresponding wild-type transmembrane protein with the $1^{st}$ generation CAR exhibited a greater decrease in impedance, indicating greater cytotoxic activity, compared to cells only expressing the $1^{st}$ generation CAR. Further, the results showed that the cytotoxic activity was greater in CAR-expressing cells that co-expressed the CD80-TIP or ICOSL-TIP relative to CAR-expressing cells that co-expressed the corresponding wild-type CD80 or ICOSL transmembrane proteins containing a non-affinity modified IgSF domain. The observed results of these TIP-engineered cells showed that cytotoxic activity in cells co-expressing the CD80-TIP or ICOSL-TIP with the CAR exhibit increased activity to modulate the cytotoxic immune response of antigen-specific T cells, such as the CAR-expressing T cells.

In the other two donors, the cells expressing the CD80-TIP did not result in a greater decreased impedance compared to cells expressing the corresponding wild-type CD80 transmembrane protein. In one donor, there were not enough cells to transduce with the wild-type transmembrane protein construct, although in this donor the ICOS-L TIP gave the best cytotoxicity compared to the other constructs tested. In the other donor, the cells expressing the ICOS-L-TIP did not result in a greater decreased impedance compared to cells expressing the corresponding wild-type ICOS-L transmembrane protein. In the tested cells, all cells co-expressing either a CD80-TIP, ICOSL-TIP or corresponding wild type transmembrane protein with the CAR exhibited greater cytotoxic activity than cells only expressing the 1st generation CAR. The differences in the results observed among donors may be related to the differences in the T cells among the donors, differences in expression levels of the various engineered proteins on the surface of the cells, the particular conditions used in this exemplary assay for assessing killing in cells (e.g. assessing Day 14 transduced cells, assessing a single effector:target cell ratio) or other factors.

Example 10

Assessment of Binding and Activity of ICOSL IgSF Domain Variants

Additional ECD ICOSL variants were identified by the yeast selection method substantially as described above and were used to produce ECD-Fc fusion proteins as described in Example 5. Binding studies were performed to assess specificity and affinity of ICOSL domain variant immunomodulatory proteins for cognate binding partners substantially as described in Example 6.

A. Binding and Functional Characterization

Binding was assessed to cells expressed full-length cognate binding partners CD28, ICOS and CTLA-4 substantially as described in Example 6. Bioactivity of the ECD ICOSL variants also was assessed in an anti-CD3 coimmobilization assay or human Mixed Lymphocyte Reaction (MLR) substantially as described in Example 6, except that for the coimmobilization assay, costimulatory activity was determined by culture of human T cells with a mixture of 10 nM plate-bound anti-CD3 and 40 nM ICOSL Fc variant proteins.

Table 15 depicts exemplary results for the additional ICOSL IgSF domain variants for binding to cell-expressed counter structures and bioactivity in the anti-CD3 coimmobilization assay or MLR assay. The exemplary amino acid substitutions depicted in Table 15 are designated by amino acid position number corresponding to the respective reference (e.g., unmodified) ICOSL ECD sequence set forth in SEQ ID NO:32. The amino acid position is indicated in the middle, with the corresponding unmodified (e.g. wild-type) amino acid listed before the number and the identified variant amino acid substitution listed after the number. Column 2 sets forth the SEQ ID NO identifier for the variant ECD for each variant ECD-Fc fusion molecule.

The results in Table 15 depict binding activity as measured by the Mean Fluorescence Intensity (MFI) value for binding of each variant Fc-fusion molecule to cells engineered to express the cognate counter structure ligand and the ratio of the MFI compared to the binding of the corresponding reference (e.g., unmodified) ECD-Fc fusion molecule not containing the amino acid substitution(s) to the same cell-expressed counter structure ligand. The functional activity of the variant Fc-fusion molecules to modulate the activity of T cells also is shown based on the calculated levels of IFN-gamma in culture supernatants (pg/mL) generated either i) with the indicated variant ECD-Fc fusion molecule coimmoblized with anti-CD3 or ii) with the indicated variant ECD-Fc fusion molecule in an MLR assay. The Table also depicts the ratio of IFN-gamma produced by each variant ECD-Fc compared to the corresponding unmodified (parental) ECD-Fc in both functional assays.

The results show altered, including increased, binding affinity of affinity-modified ICOSL IgSF domain variants for at least one cognate counter structure ligand and/or improved immunological activity. Specifically, similar to the initial hits identified in Example 6, the selections resulted in the identification of a number of additional ICOSL IgSF domain variants that were affinity-modified to exhibit increased binding for at least one, and in some cases more than one, cognate counter structure ligand. In addition, the results showed that affinity modification of the variant molecules also exhibited improved activities to both increase and/or decrease immunological activity depending on the format of the molecule as described in Example 6.

TABLE 15

ICOSL variants: binding data and costimulatory bioactivity data.

| ICOSL mutation(s) | SEQ ID NO (ECD) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/mL (parental ratio) | MLR IFN-gamma pg/mL (parental ratio) |
|---|---|---|---|---|---|---|
| N52H, F78L, Q100R, C198R | 373 | 9568 (0.12) | 1966 (0.24) | 1454 (0.12) | 130 (0.31) | 5927 (1.84) |
| N52H, N57Y, Q100R, V110D, C198R, S212G | 364 | 9418 (1.16) | 136665 (16.55) | 115352 (9.59) | 944 (2.21) | 821 (0.25) |
| N52H, N57Y, R75Q, Q100P, V110D | 374 | 5558 (0.07) | 7465 (0.90) | 4689 (0.39) | 122 (0.28) | 1136 (0.35) |
| N52H, N57Y, Q100R, C198R | 365 | 9148 (1.13) | 134923 (16.33) | 83241 (6.92) | 1060 (2.48) | 375 (0.12) |
| N52H, N57Y, L74Q, V110D, S192G | 375 | 9448 (1.17) | 128342 (15.54) | 123510 (10.26) | 1137 (2.66) | 889 (0.28) |
| N52H, Q100R | 285 | 9478 (1.17) | 151977 (18.40) | 133929 (11.13) | 972 (2.28) | 794 (0.25) |
| N52H, S121G, C198R | 376 | 9128 (1.13) | 124732 (15.10) | 182607 (15.18) | 827 (1.94) | 1257 (0.39) |
| A20V, N52H, N57Y, Q100R, S109G | 287 | 5828 (0.72) | 76973 (9.32) | 73640 (6.12) | 447 (1.05) | 2283 (0.71) |
| N52H, N57Y, Q100P, C198R | 461 | 9548 (1.18) | 130676 (15.82) | 81966 (6.81) | 1125 (2.64) | 643 (0.20) |
| N52H, N57Y, R61S, Q100R, V110D, L173S | 289 | 1018 (0.13) | 9129 (1.11) | 5790 (0.48) | 109 (0.25) | 5094 (1.58) |
| N52H, N57Y, Q100R, V122A | 290 | 9978 (1.23) | 137372 (16.63) | 70764 (5.88) | 1316 (3.08) | 473 (0.15) |
| N52H, N57Y, Q100R, F172S | 291 | 1028 (1.27) | 135821 (16.44) | 73320 (6.09) | 1561 (3.66) | 486 (0.15) |
| N52H, N57Y, Q100R | 283 | 9858 (1.22) | 140612 (17.02) | 75106 (6.24) | 1648 (3.86) | 778 (0.24) |
| N52S, F120S, N227K | 377 | 9438 (1.17) | 67796 (8.21) | 82370 (6.85) | 1157 (2.71) | 1626 (0.50) |
| N52S, N194D | 366 | 9798 (1.21) | 59431 (7.19) | 74502 (6.19) | 1671 (3.91) | 1690 (0.52) |
| N52S, V97A | 294 | 3138 (0.04) | 1733 (0.21) | 1541 (0.13) | 84 (0.20) | 3858 (1.20) |
| N52S, F120S | 293 | 9068 (1.12) | 67233 (8.14) | 97880 (8.13) | 1178 (2.76) | 2814 (0.87) |
| N52S, G72R | 295 | 9288 (1.15) | 51638 (6.25) | 62339 (5.18) | 1161 (2.72) | 2947 (0.91) |
| N52S, A71T, A117T, T190A, C198R | 378 | 8918 (1.10) | 44044 (5.33) | 56646 (4.71) | 1076 (2.52) | 4031 (1.25) |
| N52S, E220G | 297 | 3878 (0.05) | 2047 (0.25) | 1796 (0.15) | 122 (0.29) | 1927 (0.60) |
| Y47H, N52S, V107A, F120S | 298 | 3268 (0.04) | 2562 (0.31) | 2104 (0.17) | 334 (0.78) | 4390 (1.36) |
| WT ICOSL | 32 | 8088 (1.00) | 8260 (1.00) | 12033 (1.00) | 427 (1.00) | 3226 (1.00) |
| T43A, N52H, N57Y, L74Q, D89G, V110D, F172S | 379 | 2821 (0.02) | 2180 (0.49) | 2051 (0.12) | 184 (0.75) | |
| N52H, N57Y, Q100R, V107I, V110D, S132F, I154F, C198R, R221G | 381 | 174586 (0.97) | 122383 (27.24) | 76202 (4.31) | 985 (4.01) | 1037 (0.36) |
| E16V, N52H, N57Y, Q100R, V110D, H115R, Y152C, K156M, C198R | 300 | 190765 (1.05) | 129070 (28.73) | 68488 (3.87) | 4288 (17.46) | 1225 (0.43) |
| Q37R, N52H, N57Y, Q100R, V110N, S142F, C198R, D217V, R221G | 301 | 148638 (0.82) | 91104 (20.28) | 13498 (0.76) | 62 (0.25) | 7643 (2.68) |
| N52H, N57Y, Q100R, V110D, C198R | 302 | 179194 (0.99) | 123312 (27.45) | 84136 (4.76) | 762 (3.10) | 1342 (0.47) |

TABLE 15-continued

ICOSL variants: binding data and costimulatory bioactivity data.

| ICOSL mutation(s) | SEQ ID NO (ECD) | ICOS tfxn MFI (parental ratio) | CD28 tfxn MFI (parental ratio) | CTLA-4 tfxn MFI (parental ratio) | Anti-CD3 IFN-gamma Coimmobilization Assay pg/mL (parental ratio) | MLR IFN-gamma pg/mL (parental ratio) |
|---|---|---|---|---|---|---|
| N52H, N57Y, Q100R, V110D, V116A, L161M, F172S, S192G, C198R | 303 | 5236 (0.03) | 4160 (0.93) | 3305 (0.19) | 49 (0.20) | 2039 (0.72) |
| F27S, N52H, N57Y, V110N | 304 | 20154 (0.11) | 8613 (1.92) | 3903 (0.22) | 83 (0.34) | 7522 (2.64) |
| F27S, N52H, N57Y, V110N | 304 | 5236 (0.03) | 4160 (0.93) | 2957 (0.17) | 40 (0.16) | — |
| N52S, H94E, L96I, S109N, L166Q | 305 | 198604 (1.10) | 100361 (22.34) | 102892 (5.82) | 1253 (5.10) | 5645 (1.98) |
| S18R, N52S, F93L, I143V, R221G | 306 | 154561 (0.85) | 7625 (1.70) | 4254 (0.24) | 203 (0.83) | 5239 (1.84) |
| A20T, N52D, Y146C, Q164L | 307 | 149661 (0.83) | 9073 (2.02) | 6901 (0.39) | 287 (1.17) | 4829 (1.69) |
| V11E, N30D, N52H, N57Y, H94E, L96I, L98F, N194D, V210A, I218T | 308 | 180016 (1.00) | 120230 (26.76) | 62809 (3.55) | 2218 (9.03) | 7283 (2.56) |
| N52S, H94E, L96I, V122M | 309 | 198717 (1.10) | 88901 (19.79) | 94231 (5.33) | 590 (2.40) | 618 (0.22) |
| N52H, N57Y, H94E, L96I, F120I, S126T, W153R, I218N | 310 | 87711 (0.48) | 42035 (9.36) | 31798 (1.80) | 67 (0.27) | 2500 (0.88) |
| M10V, S18R, N30D, N52S, S126R, T139S, L203F | 311 | 180665 (1.00) | 64929 (14.45) | 48362 (2.73) | 1193 (4.86) | 13647 (4.79) |
| S25G, N30D, N52S, F120S, N227K | 312 | 178834 (0.99) | 66127 (14.72) | 46631 (2.64) | 1246 (5.07) | 2202 (0.77) |
| N30D, N52S, L67P, Q100K, D217G, R221K, T225S | 313 | 18630 (0.10) | 1986 (0.44) | 1940 (0.11) | 54 (0.22) | 2752 (0.97) |
| WT ICOSL | 32 | 180900 (1.00) | 4493 (1.00) | 17685 (1.00) | 246 (1.00) | 2850 (1.00) |
| R26S, N52H, N57Y, V110D, T137A, C198R | 908 | N/A | N/A | N/A | N/A | N/A |
| N52H, N57Y, Q100R, V110D, A117T, T190S, C198R | 314 | 2831 (0.04) | 2881 (0.57) | 2464 (0.23) | 59 (0.08) | — |
| N52H, N57Y, Q100R, V110D, F172S, C198R | 315 | 58478 (0.79) | 74031 (14.75) | 56850 (5.33) | 712 (0.96) | 1093 (0.23) |
| S25G, F27C, N52H, N57Y, Q100R, V110D, E135K, L173S, C198R | 316 | 22514 (0.30) | 21320 (4.25) | 20450 (1.92) | 353 (0.48) | 5765 (1.21) |
| N52H, N57Y, V110A, C198R, R221I | 317 | 84236 (1.14) | 81842 (16.31) | 121519 (11.39) | 4593 (6.18) | 1137 (0.24) |
| M10I, S13G, N52H, N57Y, D77G, V110A, H129P, I143V, F172S, V193M, C198R | 318 | 6362 (0.09) | 6001 (1.20) | 4834 (0.45) | 141 (0.19) | 4326 (0.91) |
| N52H, N57Y, R61C, Y62F, Q100R, V110N, F120S, C198R | 319 | 4355 (0.06) | 4316 (0.86) | 3430 (0.32) | 110 (0.15) | 6854 (1.44) |
| N52H, N57Y, Q100R, L102R, V110D, H115R, C198R | 367 | 96736 (1.31) | 77881 (15.52) | 148012 (13.88) | 8765 (11.79) | 630 (0.13) |
| N52H, N57Y, Q100R, V110D, N144D, F172S, C198R | 321 | 67578 (0.91) | 64953 (12.94) | 95731 (8.98) | 1672 (2.52) | 1490 (0.31) |
| N52S, H94E, L98F, Q100R, | 322 | 80690 (1.09) | 78750 (15.69) | 148160 (13.89) | 3564 (4.80) | 1497 (0.32) |
| N52S, E90A | 323 | 108908 (1.47) | 31086 (6.19) | 108866 (10.21) | 4564 (6.14) | 3927 (0.83) |
| N30D, K42E, N52S | 324 | 85726 (1.16) | 4293 (0.86) | 10755 (1.01) | 5211 (7.01) | 5656 (1.19) |
| N52S, F120S, I143V, I224V | 325 | 90862 (1.23) | 28443 (5.67) | 105229 (9.87) | 4803 (6.46) | 4357 (0.92) |
| WT ICOSL | 32 | 73964 (1.00) | 5018 (1.00) | 10665 (1.00) | 743 (1.00) | 4748 (1.00) |

B. Cytokine Production in Anti-CD3 Costimulation Assays

Exemplary variant ECD ICOSL Fc-fusion molecules described above were further assessed for stimulation of cytokines IL-17 in the anti-CD3 costimulatory (coimmobilization) bioactivity assay described above. A mixture of 10 nM plate-bound anti-CD3 and 40 nM ICOSL Fc variant proteins were cultured with human T cells. Supernatants were collected and IL-17 levels were determined by ELISA. The amount of IL-17 in culture supernatants (pg/mL) generated with the indicated variant ECD-Fc fusion molecule and corresponding unmodified (parental) ECD-Fc coimmobilized with anti-CD3 was measured. For comparison, also shown in this Table are the results for production of IFN-gamma in the same assay as depicted in Table 15 for the exemplary variants.

Results are shown in Table 16, which depict the pg/mL of IL-17 measured in the supernatant as well as the ratio (fold increase) of IL-17 produced by each variant ECD-Fc compared to the corresponding unmodified (wild-type) ECD-Fc. Similar results are shown for IFN-gamma. Also shown is the % of total IL-17 or IFN-gamma cytokine produced by cells. The results showed that affinity modification of the variant molecules exhibited altered functional T cell activity to increase IL-17 in addition to IFN-gamma in the costimulation assay.

Example 11

Generation of Additional Engineered T Cell Expressing a Transmembrane Immunomodulatory Protein and Assessment of Proliferation This Example describes the generation of additional engineered T cells in which a transmembrane immunomodulatory protein (TIP) containing an extracellular domain (ECD) containing ICOSL affinity-modified IgSF domain was co-expressed with a chimeric antigen receptor (CAR). Specifically, the TIP was generated to include the ECD of exemplary variant ICOSL containing amino acid mutations N52D), N52H/N57Y/Q100P, E16V/N52H/N57Y/Q100R/V110D/H115R/Y152C/K156M/C198R or N52H/N57Y/Q100R with reference to positions in the ICOSL extracellular domain set forth in SEQ ID NO:32. The TIP also contained a transmembrane domain and a cytoplasmic domain of the corresponding wild-type ICOSL transmembrane protein sequence corresponding to residues 257-302 of SEQ ID NO:5. The sequence of the TIP with and without its signal peptide are as follows: N52D (SEQ ID NO: 496 and 497); N52H/N57Y/Q100P (SEQ ID NO: 498 and 499); E16V/N52H/N57Y/Q100R/V110D/H115R/Y152C/K156M/C198R (SEQ ID NO: 500 and 501) and N52H/N57Y/Q100R (SEQ ID NO: 502 and 503). For comparison,

TABLE 16

Costimulatory Bioreactivity Data for ICOSL IgSF Domain Variants

| ICOSL mutation(s) | SEQ ID NO (ECD) | IL-17A [pg/mL] | IL-17A Fold ↑WT | IFN-g [pg/mL] | IFN-g Fold ↑WT | Total Fold ↑WT | % of Total Cytokine Produced % IL-17 | % IFN-g | % Total IL-17 + IFN-g |
|---|---|---|---|---|---|---|---|---|---|
| N52H, N57Y, Q100R, C198R | 365 | 617 | 7.93 | 1060 | 2.48 | 10.42 | 5.51 | 0.77 | 6.28 |
| N52H, N57Y, Q100R, V122A | 290 | 647 | 8.33 | 1316 | 3.08 | 11.41 | 5.79 | 0.96 | 6.75 |
| N52H, N57Y, Q100R, F172S | 291 | 549 | 7.06 | 1561 | 3.66 | 10.72 | 4.91 | 1.14 | 6.05 |
| N52Y, N57Y, F138L, L203P | 112 | 90 | 1.05 | 1999 | 2.69 | 3.74 | 0.81 | 2.91 | 3.72 |
| V11E, N30D, N52H, N57Y, H94E, L96I, L98F, N194D, V210A, I218T | 308 | 319 | 3.16 | 2218 | 9.03 | 12.19 | 2.85 | 3.23 | 6.08 |
| N52H, N57Y, Q100R, L102R, V110D,H115R, C198R | 367 | 510 | 5.90 | 8765 | 11.79 | 17.70 | 4.56 | 12.78 | 17.33 |
| N52H, N57Y, Q100R | 283 | 473 | 6.08 | 1648 | 3.86 | 9.94 | 4.23 | 1.20 | 5.43 |
| N52H, Q100R | 285 | 358 | 4.60 | 972 | 7.01 | 11.62 | 3.20 | 0.71 | 3.91 |
| N52H, N57Y, Q100R, V110D, C198R, S212G | 364 | 124 | 1.60 | 944 | 2.21 | 3.81 | 1.11 | 0.69 | 1.80 |
| N52H, N57Y, Q100P | 113 | 127 | 1.47 | 4922 | 6.62 | 8.09 | 1.14 | 7.17 | 8.31 |
| E16V, N52H, N57Y, Q100R, V110D, H115D, Y152C, K156M, C198R | 300 | 22 | 7.11 | 130 | 17.46 | 24.57 | 6.41 | 6.25 | 12.66 |
| N30D, K42E, N52S | 324 | 349 | 4.04 | 5211 | 7.01 | 11.05 | 3.12 | 7.60 | 10.71 |
| N52S, F120S, I143V, I224V | 325 | 292 | 3.39 | 4803 | 6.46 | 9.85 | 2.61 | 7.00 | 9.62 |
| N52S, E90A | 323 | 306 | 3.54 | 4564 | 6.14 | 9.68 | 2.73 | 6.65 | 9.39 |
| N52H, N57Y, V110A, C198R, R221I | 317 | 290 | 3.35 | 4593 | 6.18 | 9.53 | 2.59 | 6.69 | 9.28 |
| N52S, N194D | 366 | 428 | 5.50 | 1671 | 3.90 | 9.4 | 1.52 | 5.19 | 5.40 |
| N52H, I143T | 135 | 84 | — | 1727 | — | 3.30 | 0.75 | 2.52 | 3.27 |
| N52D | 111 | 126 | — | 1447 | — | 3.41 | 1.13 | 2.11 | 3.23 | the full-length transmembrane wild-type ICOSL (amino acid residues 19-302 of SEQ ID NO:5) also was expressed in cells. The sequence of the wildtype TIP with and without its signal peptide is set forth in SEQ ID NO: 494 and 495. The nucleic acid encoding the TIP also included a sequence encoding a green fluorescent protein (GFP) separated from the TIP by a self-cleaving T2A sequence.

The TIP containing the affinity-modified domain or the wild-type transmembrane protein containing a corresponding non-affinity modified IgSF domain were co-expressed in T cells with a chimeric antigen receptor (CAR). The nucleotide sequence encoding the CAR encodes, in order: a CD8 signal sequence (SEQ ID NO: 481), an anti-CD19 scFv (SEQ ID NO: 482), a hinge/transmembrane region derived from CD8 (SEQ ID NO: 483), a costimulatory signaling domain derived from 4-1BB (SEQ ID NO: 484), and a CD3zeta signaling domain (SEQ ID NO: 247). The resulting anti-CD19 CAR has the sequence of amino acids set forth in SEQ ID NO: 490. The nucleic acid encoding the CAR also included a sequence encoding a blue fluorescent protein (BFP; SEQ ID NO: 489) separated from the CAR by a self-cleaving T2A sequence (set forth in SEQ ID NO: 488).

Figure 2A:
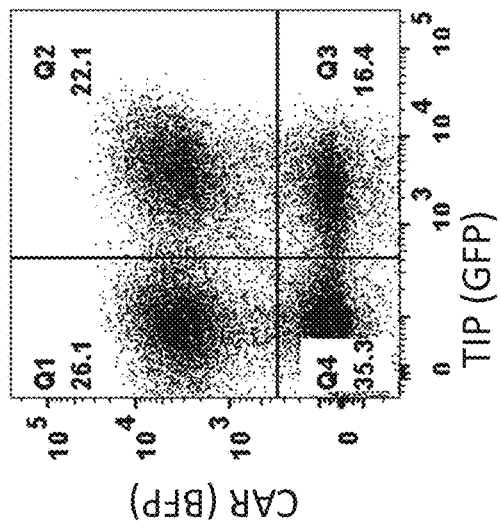
FIG. 2A depicts that primary T cells are effectively transduced with viruses encoding both the CAR and TIP proteins. Primary human T cells activated 48 hours with anti-CD3 plus anti-CD28 beads and were then transduced with a Lenti-virus encoding an anti-CD19 CAR with a BFP reporter, plus a second Lenti-virus encoding and ICOSL TIP with a GFP reporter. The FACs plot shows BFP expression on the y-axis and GFP expression on the x-axis and the percentage of T cells that fall into each quadrant are indicated. Results show that the cultures include CAR only transduced cells (upper left quadrant), TIP only transduced cells (lower right quadrant), cells transduced with both viruses (upper right quadrant) and cells that were not transduced with either (lower left).

Viral vector constructs were separately generated into which was cloned either the nucleic acid molecule encoding the CAR alone or a nucleic acid molecule encoding one of the exemplary TIPs or wild-type ICOSL. The viral vector encoding the CAR and the viral vector encoding the TIP or wild-type ICOSL were co-transduced into T cells. For transduction, primary T cells were activated with anti-CD3 and anti-CD28 beads (Dynal) at 1:1 bead:cell ratio and incubated in the presence of 100 IU/mL of IL-2 at 37° C. for 2 days. T cells were then harvested and transduced with 400 µL of CAR viral supernatant and 400 µL of TIP viral supernatant in the presence of 8 µg/mL of polybrene. The cells were spinoculated at 1000 g for 30 minutes at 30° C. The cells were then transferred and incubated overnight at 37° C. After the incubation, cells were collected and viral supernatant was removed. The cells were resuspended with complete media and 50 IU/mL of IL-2. Cells were expanded, replenished with IL-2 and media every two days for a total of 6 days. Beads were removed from the cells using a magnet and counted before being assessed in a proliferation assay. An exemplary expression profile of a TIP and CAR in an exemplary transduced T cells is shown in FIG. 2A.

To assess proliferation of CAR T cells and CAR-TIP T cells in response to antigen, cells were labeled with cell trace far red dye. CD19-expressing Nalm6 target cells were titrated starting from 1.5:1 target:T cell ratio and by 1:2 dilutions with 8-point dilution. Labeled CAR T cells or CAR-TIP T cells were added to Nalm6 cells and the culture was incubated for 4 days before cells were analyzed by flow cytometry. The supernatant was collected and further assessed in a cytokine release assay.

Figure 2B:
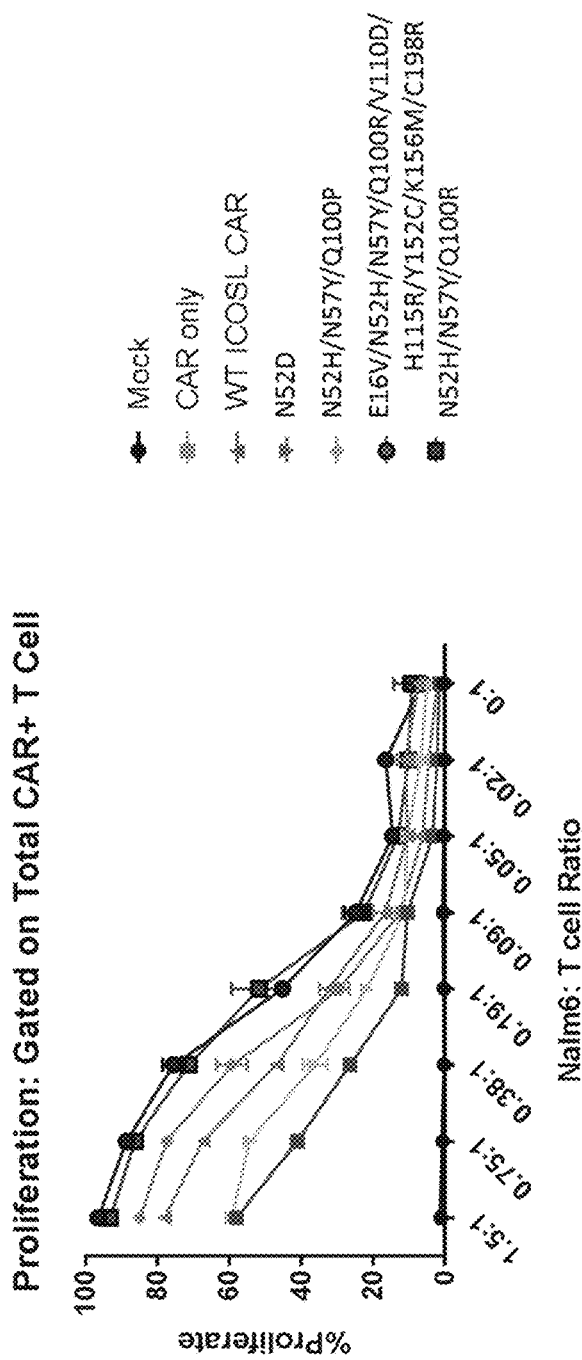
In FIG. 2B, TIPs expressed on CAR-T cells provide costimulation to the CAR-T cells. CAR-T cells with or without TIP co-transduction were labeled with Cell-Trace Far Red and incubated with the CD19+ NALM6 cell line to engage the CAR. Proliferation was assessed by the percentage of CAR-expressing cells that had diluted out the fluorescent dye. Cells transduced with mutated TIPs showed an increase proliferation of CAR+ T cells compared to those without TIPs or those transduced with wild-type ICOSL. Mock transduced cells that lacked CAR expression failed to proliferate in this assay.

As shown in FIG. 2B, CAR+ primary T cells proliferate in a dose dependent manner to CD19+ NALM6 cells. Compared to a CAR only T cells, T cells coexpressing the CAR and either wild-type ICOSL or one of the exemplary ICOSL TIP exhibited enhanced proliferation compared to CAR only expressing T cells. Co-expression of a CAR and a TIP containing either the N52H/N57Y/Q100P, E16V/N52H/N57Y/Q100R/V110D/H115R/Y152C/K156M/C198R or N52H/N57Y/Q100R variant ICOSLECD exhibited greater proliferation than T cells co-expressing the CAR and wildtype ICOSL, indicating that TIPs expressed on primary T cells provide an improved costimulatory signal to enhance T cell proliferation.

Example 12

Purification and Assessment of Purified of ICOSL IgSF Domain Variants

A purification strategy was employed for exemplary candidate hits described in Example 6 and 10. Human cells derived from the 293 cell line (Expi293) were transiently transfected with expression construct and the ECD ICOSL Fc fusion molecule was expressed in the cells. The Fc fusion proteins were then purified from supernatants with Protein A by affinity chromatography (MabSelect SuRe). This initial purification step was then followed by a preparative size exclusion chromatography (SEC) step to further purify the proteins (Superdex200 16×60). Samples from both purification steps were retained and compared by analytic SEC. The concentration of the protein was determined after Protein A purification. The resulting purified proteins also were analyzed by analytic SEC on a high performance liquid chromatography (HPLC) to assess purity.

The percent main peak in the purified samples was determined and compared to protein purified in the initial Protein A step (% Main Peak Prot A pool) versus protein purified with Protein A followed by preparative SEC (% Main Peak SEC pool T=D0). As shown in Table 17, the additional SEC step substantially increased protein purity of purified proteins. To further assess stability of the proteins, proteins purified by preparative SEC were left at room temperature for 24 hours and then % Main Peak by HPLC (% Main Peak SEC pool T=D24) was assessed and compared to D0 sample. The change in % Main Peak at D0 versus D24 was determined (▲% Main Peak SEC pool). As shown in Table 17, most of the tested exemplary variant ECD ICOSL Fc fusion molecules exhibited little change in % Main Peak at this time, indicating minimal aggregation of the protein variants had occurred.

TABLE 17

| Purification of ICOSL Protein Variants | | | | | | |
|---|---|---|---|---|---|---|
| ICOSL mutation(s) | SEQ ID NO (ECD) | Expi293 Prod. Prot A mg/L | % Main Peak Prot A pool | % Main Peak SEC pool T = D0 | % Main Peak SEC pool T = D24 | ▲ % Main Peak SEC pool |
| N52S, N194D | 366 | 120 | 87.9 | 93.5 | 92 | 1.5 |
| N52H, N57Y, Q100R, F172S | 291 | 217 | 86.9 | 97.4 | 95.6 | 1.8 |
| N52S, E90A | 323 | 128 | 86.5 | 89.5 | 88.3 | 1.2 |
| N52H, Q100R | 285 | 176 | 85.9 | 97.5 | 96.1 | 1.4 |
| N52H, N57Y, Q100R | 283 | 186 | 85.1 | 97.6 | 95.7 | 1.9 |
| N52S, F120S, I143V, I224V | 325 | 87 | 83.2 | 88.9 | 88.3 | 0.6 |
| N52H, N57Y, Q100R, C198R | 365 | 204 | 82.9 | 95.8 | 92.3 | 3.5 |
| N52H, N57Y, Q100P | 113 | 63 | 80.5 | 94.5 | 88.5 | 6 |
| N30D, K42E, N52S | 324 | 81 | 80 | 95.4 | 91.3 | 4.1 |

TABLE 17-continued

Purification of ICOSL Protein Variants

| ICOSL mutation(s) | SEQ ID NO (ECD) | Expi293 Prod. Prot A mg/L | % Main Peak Prot A pool | % Main Peak SEC pool T = D0 | % A Main Peak SEC pool T = D24 | Main Peak SEC pool |
|---|---|---|---|---|---|---|
| N52H, N57Y, Q100R, L102R, V110D, H115R, C198R | 367 | 141 | 78.9 | 96 | 92.9 | 3.1 |
| N52H, N57Y, Q100R, V122A | 290 | 260 | 77.6 | 96.4 | 95.2 | 1.2 |
| N52Y/N57Y/F138L/L203P | 112 | 40 | 75.6 | 96.8 | 94.8 | 2 |
| E16V, N52H, N57Y, Q100R, V110D, H115R, Y152C, K156M, C198R | 300 | 60 | 73.8 | 97.1 | 95.8 | 1.3 |
| N52H, N57Y, V110A, C198R, R221I | 317 | 95 | 65.4 | 90.9 | 86 | 4.9 |
| N52H, N57Y, Q100R, V110D, C198R, S212G | 364 | 73 | 50.6 | 87.9 | 78.6 | 9.3 |
| V11E, N30D, N52H, N57Y, H94E, L96I, L98F, N194D, V210A, I218T | 308 | 58 | — | — | — | — |
| N52H, I143T | 135 | 134 | 93.2 | 96 | 92.7 | 3.3 |
| N52D | 111 | 136 | 90.4 | 95.5 | 93.3 | 2.2 |

Example 13

Assessment of Costimulatory Bioactivity of Purified ICOSL IgSF Domain Variant Hits Exemplary ECD ICOSL Fc fusion molecules purified as described in Example 12 were assessed for bioactivity by MLR substantially as described in Example 6. A mixture of 10 nM or 40 nM ICOSL Fc variant proteins was bound overnight to 96-well plates in the presence of 10 nM anti-CD3. The plates were washed and 100,000 CFSE labelled pan T cells were added for 96 hours. Supernatants were collected, and IFN-gamma and IL-17 levels were measured by ELISA.

Figure 3B:
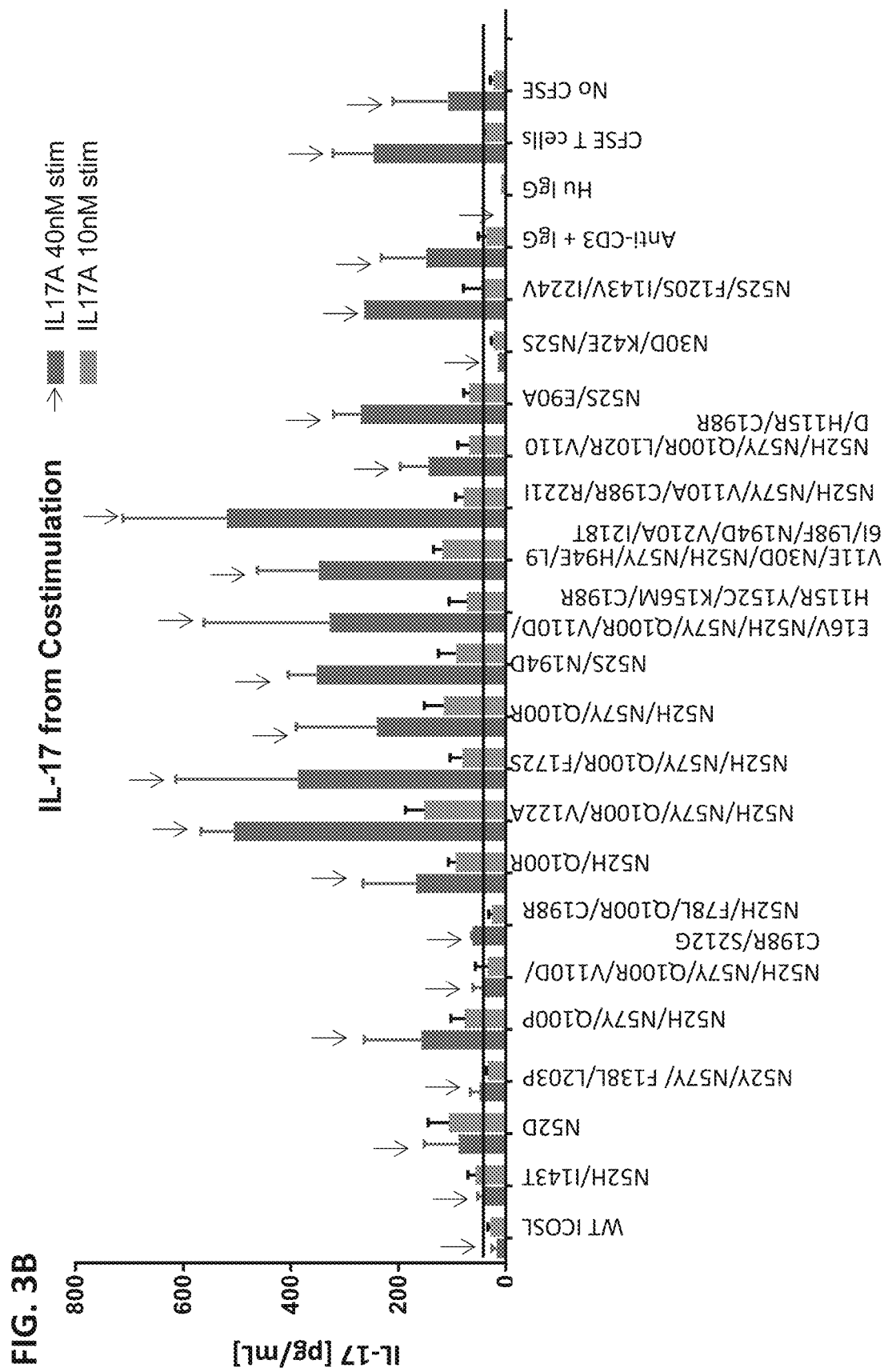

Results for the cytokine secretion induced by anti-CD3 costimulation with exemplary tested variants (10 nM and 40 nM ICOSL Fc) are shown in FIGS. 3A and 3B, which indicates exemplary IgSF domain amino acid substitutions (replacements) in the ECD of ICOSL. The bar graphs in FIGS. 3A and 3B depict the amount of secreted IFN-gamma and IL-17, respectively, by ELISA in the supernatants (pg/mL). The level of cytokine release induced by anti-CD3 costimulation with the tested variants compared to the level induced by anti-CD3 costimulation with WT ICOSL is indicated by the horizontal line. The results showed that affinity modification of the variant molecules exhibited activity to modulate functional T cell activity, including to substantially increase IFN-gamma and IL-17 secretion in the costimulation assay. Increased immunological activity was observed with some variants.

Example 14

Assessment of Proliferation of Purified ICOSL IgSF Domain Variant Hits

Exemplary variant ECD ICOSL Fc fusion molecules purified as described in Example 12 were assessed for ability to costimulate anti-CD3-induced proliferation of T cells. Primary T cells were labeled with carboxyfluorescein succinimidyl ester (CFSE). A mixture of 10 nM or 40 nM variant ECD ICOSL Fc or wild-type ECD ICOSL proteins were bound overnight to 96-well plates in the presence of 10 nM anti-CD3, and then labeled T cells were added and incubated for 3 days. As a control, proliferation also was assessed in the presence of bound anti-CD3 and IgG or IgG alone. Cells were stained for CD4 or CD8 surface markers and proliferation of total T cells, CD4+ T cells or CD8+ T cells was determined by assessing CFSE dilution by flow cytometry.

Figure 4A:
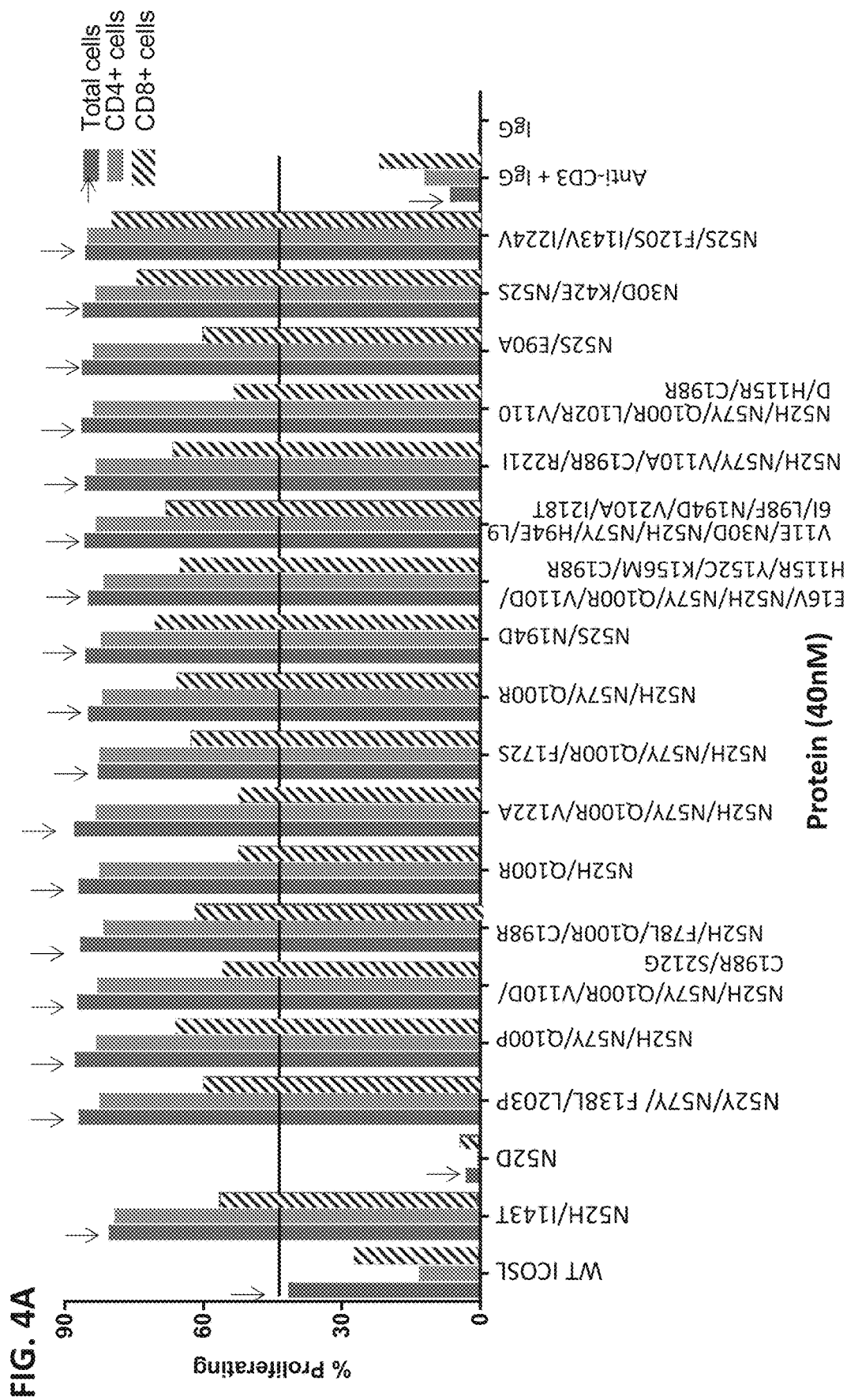

The results are set forth in FIG. 4A and FIG. 4B for exemplary variants tested at 40 nM and 10 nM ICOSL, respectively. As shown in FIG. 4A, nearly all tested variant ECD ICOSL Fc fusion molecules induced proliferation greater than WT control. As shown in FIG. 4B, differences in proliferation were more apparent at 10 nM with certain variants providing maximal proliferation even at this lower concentration.

Example 15

Assessment of Binding and Activity of Purified ICOSL IgSF Domain Variant Hits

Exemplary variant ECD ICOSL Fc fusion molecules purified as described in Example 12 were assessed for binding and functional activities using methods substantially as described in Example 6 or Example 10.

A. Flow Cytometric Binding Assays

Human cells derived from the 293 cell line (Expi293) were transfected with CD28, CTLA-4, ICOS or mock transfected. Cells were then incubated with ECD ICOSL Fc fusion molecules or wild-type ECD ICOSL-Fc that were titrated from 100,000 pM to 46 pM, and binding was observed using a PE-conjugated anti-human Fc as described in Example 6. Binding was assessed by flow cytometry and mean fluorescence intensity (MFI) and percent (%) of cells positive for signal was determined using Cell Quest Pro software (Becton Dickinson, USA). The concentration of ICOSL-Fc that gave a half-maximal MFI response (MFI EC50) or % positive cells (% (+) EC50) was determined.

Table 18 sets forth the results. The ICOSL amino acid substitutions depicted in Table 18 are designated by amino acid position number corresponding to the respective reference (e.g., unmodified) ICOSL ECD sequence set forth in SEQ ID NO:32. For some values (e.g. WT binding to CD28) it was not possible to obtain an EC50, therefore 1000000 pM was arbitrarily picked for data formatting purposes. Similar to results obtained from previous binding assays as described in Example 10 above, altered binding affinity of variant ICOSL ECD-Fc fusion molecule for at least one cognate counter structure ligand was observed.

TABLE 18

Flow Cytometric EC50s for ICOSL variants

| ICOSL mutation(s) | SEQ ID NO (ECD) | CD28 MFI EC50 [pM] | CD28 % (+) EC50 [pM] | CTLA-4 MFI EC50 [pM] | CTLA-4 % (+) EC50 [pM] | ICOS MFI EC50 [pM] | ICOS % (+) EC50 [pM] |
|---|---|---|---|---|---|---|---|
| WT ICOSL | 32 | 1000000 | 1000000 | 1000000 | 1000000 | 10543 | 762 |
| N52H, I143T | 135 | 19147 | 567 | 20259 | 1891 | 2666 | 286 |
| N52H, N57Y, Q100R, C198R | 365 | 950 | 159 | 73548 | 422 | 1032 | 179 |
| N52H, N57Y, Q100R, V122A | 290 | 29701 | 152 | 1008 | 293 | 302 | 64 |
| N52H, N57Y, Q100R, F172S | 291 | 1006 | 231 | 1332 | 396 | 779 | 130 |
| N52Y/N57Y/F138L/L203P | 112 | 7844 | 386 | 7457 | 994 | 3104 | 408 |
| V11E, N30D, N52H, N57Y, H94E, L96I, L98F, N194D, V210A, I218T | 308 | 5961 | 595 | 6909 | 1026 | 5514 | 852 |
| N52H, N57Y, Q100R, L102R, V110D, H115R, C198R | 367 | 1034 | 307 | 23328 | 579 | 3172 | 347 |
| N52H, N57Y, Q100R | 283 | 1665 | 238 | 11002 | 533 | 383 | 131 |
| N52H, Q100R | 285 | 1305 | 274 | 8593 | 1997 | 702 | 167 |
| N52H, N57Y, Q100R, V110D, C198R, S212G | 364 | 4987 | 594 | 30382 | 922 | 50219 | 814 |
| N52H, N57Y, Q100P | 113 | 21137 | 402 | 22651 | 758 | 4090 | 320 |
| E16V, N52H, N57Y, Q100R, V110D, H115R, Y152C, K156M, C198R | 300 | 2508 | 387 | 5399 | 806 | 2381 | 421 |
| N30D, K42E, N52S | 324 | — | 3683800 | 8593 | 1997 | 3251 | 558 |
| N52S, F120S, I143V, I224V | 325 | 902400 | 9060 | 28126 | 2948 | 4366 | 245 |
| N52S, E90A | 323 | 1339700 | 31302 | 31419 | 5828 | 5225 | 473 |
| N52H, N57Y, V110A, C198R, R221I | 317 | 1809 | 426 | 7201 | 841 | 1293 | 433 |
| N52S, N194D | 366 | 944669 | 11876 | 1254880 | 5170 | 473 | 206 |
| N52D | 111 | 288617 | 17793 | 396841 | 3891 | 2642 | 137 |

B. ForteBio Binding Assay

Protein-protein interactions between the receptors and ICOSL domain variant immunomodulatory proteins were further assessed using Fortebio binding assays. ICOS, CD28, and CTLA-4 receptors were loaded individually onto anti-human capture sensors (ForteBio Octet AHC) and wild-type unmodified ICOSL ECD-Fc fusion molecule, wildtype PD-L2 ED-Fc fusion molecule or variant ICOSL Fc-fusion molecules were bound to the receptors in 4 point titrations. Each titration was globally fit to calculate the associate ($k_{on}$) and dissociation ($K_{dis}$) of each protein. Loading response of anti-human capture sensors of each receptor being tested with the variant ICOSL ECD-Fc fusion molecule was determined. The dissociation constant (KD) was calculated and compared to wildtype to determine a fold improvement value (fold imp.).

Binding results to ICOS are set forth in Table 19, to CD28 are set forth in Table 20 and to CTLA-4 are set forth in Table 21. The exemplary amino acid substitutions depicted in Table 19-21 are designated by amino acid position number corresponding to the respective reference unmodified ICOSL ECD sequence set forth in SEQ ID NO:32.

TABLE 19

ICOS ForteBio Binding Assay

| ICOSL mutation(s) | SEQ ID NO (ECD) | Response | KD (M) | $K_{on}$ (1/Ms) | $K_{dis}$ (1/s) | Full $R^2$ | Fold Imp. |
|---|---|---|---|---|---|---|---|
| WT ICOSL | 32 | 0.73 | 8.83E−10 | 1.78E+05 | 1.58E−04 | 0.9908 | — |
| N52H, I143T | 135 | 0.87 | 3.32E−10 | 3.13E+05 | 1.04E−04 | 0.9683 | 2.7 |
| N52H, N57Y, Q100R, C198R | 365 | 0.74 | 4.92E−10 | 3.85E+05 | 1.89E−04 | 0.9882 | 1.8 |
| N52H, N57Y, Q100R, V122A | 290 | 0.67 | 4.72E−10 | 3.77E+05 | 1.78E−04 | 0.9775 | 1.9 |
| N52H, N57Y, Q100R, F172S | 291 | 0.68 | 4.20E−10 | 4.34E+05 | 1.82E−04 | 0.9545 | 2.1 |
| N52Y/N57Y/F138L/L203P | 112 | 0.64 | 7.69E−10 | 2.22E+05 | 1.71E−04 | 0.9782 | 1.1 |

TABLE 19-continued

ICOS ForteBio Binding Assay

| ICOSL mutation(s) | SEQ ID NO (ECD) | Response | KD (M) | $K_{on}$ (1/Ms) | $K_{dis}$ (1/s) | Full $R^2$ | Fold Imp. |
|---|---|---|---|---|---|---|---|
| V11E, N30D, N52H, N57Y, H94E, L96I, L98F, N194D, V210A, I218T | 308 | 0.67 | 3.62E−10 | 3.55E+05 | 1.29E−04 | 0.9687 | 2.4 |
| N52H, N57Y, Q100R, L102R, V110D, H115R, C198R | 367 | 0.76 | 4.77E−10 | 3.29E+05 | 1.57E−04 | 0.9616 | 1.9 |
| N52H, N57Y, Q100R | 283 | 0.74 | 3.69E−10 | 2.87E+05 | 1.06E−04 | 0.9817 | 2.4 |
| N52H, Q100R | 285 | 0.79 | 3.73E−10 | 4.45E+05 | 1.66E−04 | 0.968 | 2.4 |
| N52H, N57Y, Q100R, V110D, C198R, S212G | 364 | 0.60 | 1.29E−09 | 1.66E+05 | 2.15E−04 | 0.9846 | 0.7 |
| N52H, N57Y, Q100P | 113 | 0.73 | 3.82E−10 | 3.71E+05 | 1.42E−04 | 0.9729 | 2.3 |
| E16V, N52H, N57Y, Q100R, V110D, H115R, Y152C, K156M, C198R | 300 | 0.75 | 5.43E−10 | 2.65E+05 | 1.44E−04 | 0.9848 | 1.6 |
| N30D, K42E, N52S | 324 | 0.80 | 3.71E−10 | 4.48E+05 | 1.66E−04 | 0.9651 | 2.4 |
| N52S, F120S, I143V, I224V | 325 | 0.80 | 3.11E−10 | 5.03E+05 | 1.56E−04 | 0.9673 | 2.8 |
| N52S, E90A | 323 | 0.88 | 3.40E−10 | 4.85E+05 | 1.65E−04 | 0.9792 | 2.6 |
| N52H, N57Y, V110A, C198R, R221I | 317 | 0.68 | 4.77E−10 | 3.15E+05 | 1.50E−04 | 0.976 | 1.9 |
| N52S, N194D | 366 | 0.88 | 3.37E−10 | 3.38E+05 | 1.14E−04 | 0.9723 | 2.6 |
| N52D | 111 | 0.87 | 3.38E−10 | 3.91E+05 | 1.32E−04 | 0.9792 | 2.6 |
| Wildtype PD-L2 ED-Fc | — | 0.03 | | | | | |

TABLE 20

CD28 ForteBio Binding Assay

| ICOSL mutation(s) | SEQ ID NO (ECD) | Response | KD (M) | $K_{on}$ (1/Ms) | $K_{dis}$ (1/s) | Full $R^2$ | Fold Imp. |
|---|---|---|---|---|---|---|---|
| WT ICOSL | 32 | 0.33 | 1.39E−08 | 6.69E+04 | 9.29E−04 | 0.9715 | — |
| N52H, I143T | 135 | 0.95 | 5.25E−10 | 4.27E+05 | 2.24E−04 | 0.9877 | 26.5 |
| N52H, N57Y, Q100R, C198R | 365 | 1.14 | 4.47E−10 | 4.12E+05 | 1.84E−04 | 0.9877 | 31.0 |
| N52H, N57Y, Q100R, V122A | 290 | 1.04 | 3.90E−10 | 4.07E+05 | 1.59E−04 | 0.9878 | 35.6 |
| N52H, N57Y, Q100R, F172S | 291 | 1.06 | 2.93E−10 | 4.26E+05 | 1.25E−04 | 0.9836 | 47.3 |
| N52Y/N57Y/F138L/L203P | 112 | 0.86 | 7.83E−10 | 1.79E+05 | 1.40E−04 | 0.993 | 17.7 |
| V11E, N30D, N52H, N57Y, H94E, L96I, L98F, N194D, V210A, I218T | 308 | 0.92 | 5.53E−10 | 2.54E+05 | 1.40E−04 | 0.9906 | 25.1 |
| N52H, N57Y, Q100R, L102R, V110D, H115R, C198R | 367 | 1.10 | 3.66E−10 | 3.41E+05 | 1.25E−04 | 0.986 | 37.9 |
| N52H, N57Y, Q100R | 283 | 1.04 | 3.68E−10 | 3.72E+05 | 1.37E−04 | 0.983 | 37.7 |
| N52H, Q100R | 285 | 1.09 | 4.01E−10 | 5.0SE+05 | 2.02E−04 | 0.9938 | 34.7 |
| N52H, N57Y, Q100R, V110D, C198R, S212G | 364 | 0.94 | 8.96E−10 | 1.78E+05 | 1.60E−04 | 0.9961 | 15.5 |
| N52H, N57Y, Q100P | 113 | 0.99 | 4.36E−10 | 3.29E+05 | 1.43E−04 | 0.9835 | 31.8 |
| E16V, N52H, N57Y, Q100R, V110D, H115R, Y152C, K156M, C198R | 300 | 1.06 | 5.03E−10 | 3.06E+05 | 1.54E−04 | 0.9872 | 27.6 |
| N30D, K42E, N52S | 324 | 0.54 | 1.95E−09 | 2.74E+05 | 5.33E−04 | 0.9772 | 7.1 |
| N52S, F120S, I143V, I224V | 325 | 0.84 | 9.10E−10 | 4.51E+05 | 4.10E−04 | 0.9742 | 15.3 |
| N52S, E90A | 323 | 0.94 | 9.69E−10 | 4.74E+05 | 4.59E−04 | 0.978 | 14.3 |
| N52H, N57Y, V110A, C198R, R221I | 317 | 0.94 | 5.63E−10 | 2.63E+05 | 1.48E−04 | 0.9781 | 24.7 |
| N52S, N194D | 366 | 0.82 | 1.04E−09 | 3.53E+05 | 3.68E−04 | 0.9887 | 13.3 |
| N52D | 111 | 0.86 | 1.16E−09 | 3.36E+05 | 3.90E−04 | 0.989 | 11.9 |
| wildtype PD-L2 ED-Fc | — | −0.04 | | | | | |

TABLE 21

CTLA-4 ForteBio Binding Assay

| ICOSL mutation(s) | SEQ ID NO (ECD) | Response | KD (M) | $K_{on}$ (1/Ms) | $K_{dis}$ (1/s) | Full $R^2$ | Fold Imp. |
|---|---|---|---|---|---|---|---|
| WT ICOSL | 32 | 0.21 | 7.71E−08 | 1.92E+04 | 1.48E−03 | 0.8919 | — |
| N52H, I143T | 135 | 0.96 | 6.78E−10 | 7.26E+05 | 4.92E−04 | 0.9641 | 113.8 |
| N52H, N57Y, Q100R, C198R | 365 | 1.57 | 6.45E−10 | 4.79E+05 | 3.09E−04 | 0.9875 | 119.6 |

TABLE 21-continued

CTLA-4 ForteBio Binding Assay

| ICOSL mutation(s) | SEQ ID NO (ECD) | Response | KD (M) | $K_{on}$ (1/Ms) | $K_{dis}$ (1/s) | Full $R^2$ | Fold Imp. |
|---|---|---|---|---|---|---|---|
| N52H, N57Y, Q100R, V122A | 290 | 1.43 | 5.76E−10 | 4.73E+05 | 2.72E−04 | 0.9926 | 133.9 |
| N52H, N57Y, Q100R, F172S | 291 | 1.47 | 5.36E−10 | 5.13E+05 | 2.75E−04 | 0.9924 | 144.0 |
| N52Y/N57Y/F138L/L203P | 112 | 1.33 | 8.33E−10 | 3.45E+05 | 2.87E−04 | 0.9943 | 92.6 |
| V11E, N30D, N52H, N57Y, H94E, L96I, L98F, N194D, V210A, I218T | 308 | 1.50 | 6.48E−10 | 3.12E+05 | 2.02E−04 | 0.9943 | 119.0 |
| N52H, N57Y, Q100R, L102R, V110D, H115R, C198R | 367 | 1.60 | 8.64E−10 | 4.79E+05 | 4.14E−04 | 0.9825 | 89.2 |
| N52H, N57Y, Q100R | 283 | 1.65 | 7.19E−10 | 4.28E+05 | 3.08E−04 | 0.9895 | 107.2 |
| N52H, Q100R | 285 | 1.17 | 5.92E−10 | 8.37E+05 | 4.96E−04 | 0.9629 | 130.3 |
| N52H, N57Y, Q100R, V110D, C198R, S212G | 364 | 1.32 | 1.47E−09 | 2.34E+05 | 3.44E−04 | 0.9937 | 52.6 |
| N52H, N57Y, Q100P | 113 | 1.51 | 6.47E−10 | 3.61E+05 | 2.33E−04 | 0.9911 | 119.2 |
| E16V, N52H, N57Y, Q100R, V110D, H115R, Y152C, K156M, C198R | 300 | 1.58 | 1.06E−09 | 4.24E+05 | 4.49E−04 | 0.9779 | 72.8 |
| N30D, K42E, N52S | 324 | 0.42 | 2.81E−09 | 2.42E+05 | 6.81E−04 | 0.9676 | 27.4 |
| N52S, F120S, I143V, I224V | 325 | 0.58 | 1.20E−09 | 3.10E+05 | 3.72E−04 | 0.9283 | 64.3 |
| N52S, E90A | 323 | 0.64 | 1.12E−09 | 3.28E+05 | 3.68E−04 | 0.9184 | 68.7 |
| N52H, N57Y, V110A, C198R, R221I | 317 | 1.44 | 1.07E−09 | 4.05E+05 | 4.32E−04 | 0.9811 | 72.3 |
| N52S, N194D | 366 | 0.59 | 2.52E−09 | 2.66E+05 | 6.69E−04 | 0.9643 | 30.6 |
| N52D | 111 | 0.62 | 1.52E−09 | 4.16E+05 | 6.32E−04 | 0.9234 | 50.7 |
| wildtype PD-L2 ED-Fc | — | 0.00 | | | | | |

C. Coimmobilization Assay

Costimulatory bioactivity of ICOSL fusion variants was determined in anti-CD3 coimmobilization assays substantially as described in Example 6. Approximately 0.37 nM, 1.3 nM or 10 nM mouse anti-human CD3 (OKT3, Biolegends, USA) was diluted in PBS with 10 nM or 40 nM variant ICOSL ECD Fc or wild-type ICOSL ECD-Fc. This mixture was added to tissue culture treated flat bottom 96 well plates overnight to facilitate adherence of the stimulatory proteins to the wells of the plate. The next day, unbound protein was washed off the plates and 100,000 purified human pan T cells were added to each well. Cells were cultured 3 days before harvesting culture supernatants and measuring human IFN-gamma levels with an ELISA kit.

Table 22 sets fort the amount of IFN-gamma (pg/mL) produced by cells under the various conditions in the anti-CD3 coimmobilization assay. In the Table, the amino acid substitutions of exemplary variant ECD ICOSL-Fc fusions are designated by amino acid position number corresponding to the unmodified ICOSL ECD sequence set forth in SEQ ID NO: 32 and the corresponding SEQ ID NO identifier for the variant ECD for each variant ICOSL ECD-Fc fusion molecule is set forth. The ratio of IFN-gamma produced in the presence of each variant ICOSL ECD-Fc in the functional assay compared to in the presence of the corresponding unmodified (wildtype) ECD-Fc is shown (Fold ↑WT). As shown, costimulatory signaling of the variant ICOSL-ECD-Fc molecules were substantially greater compared to wildtype ICOSL.

TABLE 22

Assessment of IFN-gamma Responses in Co-stimulation Assay

| | | IFN-gamma [pg/mL] | | | | | |
|---|---|---|---|---|---|---|---|
| | | 40 nM Ligand | | 10 nM Ligand | | 40 nM Ligand | | |
| ICOSL mutation(s) | SEQ ID NO (ECD) | 10 mM OKT3 | Fold ↑WT | 10 mM OKT3 | Fold ↑WT | 10 mM OKT3 | 1.1 nM OKT3 | 0.37 nM OKT3 |
| E16V, N52H, N57Y, Q100R, V110D, H115R, Y152C, K156M, C198R | 300 | 14372 | 17.3 | 4903 | 29.9 | 8379.2 | 7422.8 | 2893.7 |
| N52H, N57Y, Q100R, V122A | 290 | 10640 | 12.8 | 6456 | 39.4 | 5636.2 | 4724.2 | 2246.3 |
| N52H, N57Y, Q100R, F172S | 291 | 10379 | 12.5 | 3741 | 22.8 | 3979.7 | 4067.7 | 1415.5 |
| N52H, N57Y, Q100R, C198R | 365 | 9590 | 11.5 | 4048 | 24.7 | 4215.8 | 2787.1 | 1072.4 |
| N52H, N57Y, Q100R | 283 | 9568 | 11.5 | 3270 | 19.9 | 4412.3 | 3862.0 | 1820.0 |
| N52H, N57Y, Q100R, L102R, V110D, H115R, C198R | 367 | 6939 | 8.4 | 3234 | 19.7 | 5495.2 | 4081.6 | 1442.8 |
| N52S, F120S, I143V, I224V | 325 | 6567 | 7.9 | 717 | 4.4 | 2145.4 | 2185.7 | 646.1 |
| N52S, N194D | 366 | 5690 | 6.8 | 272 | 1.7 | 2315.1 | 1485.0 | 1140.6 |

TABLE 22-continued

Assessment of IFN-gamma Responses in Co-stimulation Assay

| | | IFN-gamma [pg/mL] | | | | | | |
|---|---|---|---|---|---|---|---|---|
| | SEQ | 40 nM Ligand | | 10 nM Ligand | | 40 nM Ligand | | |
| ICOSL mutation(s) | ID NO (ECD) | 10 mM OKT3 | Fold ↑WT | 10 mM OKT3 | Fold ↑WT | 10 mM OKT3 | 1.1 nM OKT3 | 0.37 nM OKT3 |
| V11E, N30D, N52H, N57Y, H94E, L96I, L98F, N194D, V210A, I218T | 308 | 5345 | 6.4 | 1152 | 7.0 | 2747.0 | 3383.4 | 1701.2 |
| N52S, E90A | 323 | 5097 | 6.1 | 706 | 4.3 | 5019.8 | 3036.4 | 1482.4 |
| N52H, N57Y, V110A, C198R, R221I | 317 | 4737 | 5.7 | 520 | 3.2 | 2501.5 | 1632.1 | 937.5 |
| N52H, Q100R | 285 | 4122 | 5.0 | 1466 | 8.9 | 5782.1 | 2861.4 | 967.5 |
| N30D, K42E, N52S | 324 | 4080 | 4.9 | 273 | 1.7 | 1336.8 | 1260.7 | 541.1 |
| N52H, N57Y, Q100P | 113 | 3344 | 4.0 | 229 | 1.4 | 2525.4 | 2439.5 | 1233.9 |
| N52H, N57Y, Q100R, V110D, C198R, S212G | 364 | 3064 | 3.7 | 1471 | 9.0 | 2699.5 | 2629.9 | 678.2 |
| N52Y, N57Y, F138L, L203P | 112 | 2177 | 2.6 | 200 | 1.2 | 1889.5 | 1757.9 | 808.8 |
| N52H, I143T | 135 | 1906 | 2.3 | 138 | 0.8 | 1417.1 | 1367.9 | 275.2 |
| WT ICOSL | 32 | 831 | 1.0 | 164 | 1.0 | 558.8 | 377.7 | 152.0 |
| N52D | 111 | 88 | 0.1 | 231 | 1.4 | 1288.9 | 1737.9 | 289.0 |

D. Mixed Lymphocyte Reaction for Assessment of Bioreactivity Suppression

Modulation of T cell activity by fusion variants was determined in a mixed lymphocyte reaction (MLR) substantially as described in Example 6. Human monocytes were incubated for 6 days in the presence of IL-4 and GM-CSF and matured to dendritic cells with the additional of LPS for the final 24 hours. $1\times10^4$ dendritic cells and $1\times10^5$ human CFSE-labeled T cells were plated per well and incubated for 4 days in the presence of three different concentrations (40 nM, 13.3 nM or 4.4 nM) of wildtype or recombinant variant ICOSL ECD-Fc molecules diluted in PBS. The same concentrations of human IgG, PD-L2-Fc or Belatacept (CTLA4-Fc containing L104E and A29Y mutations) were used as controls. Supernatants were harvested and IFN-gamma responses were characterized by ELISA.

Figure 5:
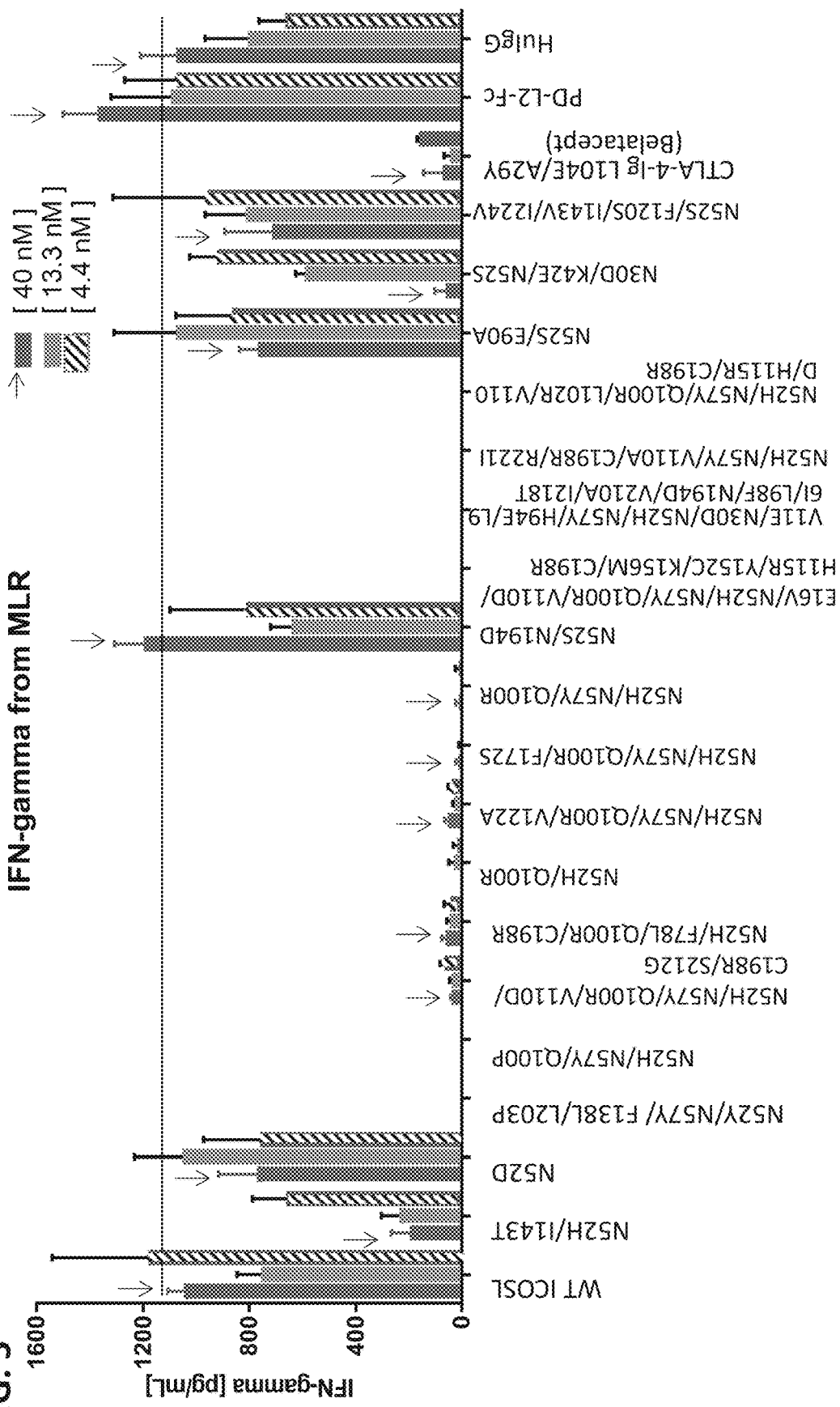
FIG. 5 depicts ICOSL vIgD candidate function in a human Mixed-Lymphocyte-Reaction (MLR). ICOSL variants and their mutations are listed on the x-axis, along with wild-type ICOSL, negative controls PDL2-Fc and human IgG, as well as the positive control benchmark molecule CTLA-Ig Belatacept. The line across the graph represents the baseline amount of IFN-gamma detected in the supernatants of negative control cultures. For each ICOSL variant candidate or control, three different concentrations were tested with arrows indicating the highest concentration of protein in cultures at 40 nM. The majority of ICOSL variant candidates show superior antagonistic activity at all three concentrations tested compared to belatacept as reflected by the lower concentration of IFN-gamma in those cultures.

FIG. 5 depicts the IFN-gamma production under the various conditions. The levels of IFN-gamma produced by cells in the presence of wild-type ICOSL is set forth by the horizontal line. No suppression of IFN-gamma production was observed in the presence of negative control protein PD-L2-Fc. In contrast, most of the tested ICOSL variants exhibited some degree of inhibition of IFN-gamma production in the MLR. Certain variants exhibited substantial inhibition of IFN-gamma with very low to no detectable IFN-gamma produced in the cultures, even at the lowest concentration of 4.4 nM tested. The percent MLR suppression in the presence of 4.4 nM of variant of variant ECD ICOSL-Fc is set forth in Table 23. In the Table, the negative values indicate an inflammatory effect in the assay.

TABLE 23

Costimulatory bioactivity data for ICOSL in MLR

| ICOSL mutation(s) | SEQ ID NO (ECD) | % MLR Suppresion (4.4 nM) |
|---|---|---|
| N52H, N57Y, Q100R, C198R | 365 | 93.6 |
| N52H, N57Y, Q100R, V122A | 290 | 94.4 |
| N52H, N57Y, Q100R, F172S | 291 | 100.0 |
| N52Y/N57Y/F138L/L203P | 112 | 100.0 |

TABLE 23-continued

Costimulatory bioactivity data for ICOSL in MLR

| ICOSL mutation(s) | SEQ ID NO (ECD) | % MLR Suppresion (4.4 nM) |
|---|---|---|
| V11E, N30D, N52H, N57Y, H94E, L96I, L98F, N194D, V210A, I218T | 308 | 100.0 |
| N52H, N57Y, Q100R, L102R, V110D, H115R, C198R | 367 | 100.0 |
| N52H, N57Y, Q100R | 283 | 98.2 |
| N52H, Q100R | 285 | 97.5 |
| N52H, N57Y, Q100R, V110D, C198R, S212G | 364 | 90.4 |
| N52H, N57Y, Q100P | 113 | 100.0 |
| E16V, N52H, N57Y, Q100R, V110D, H115R, Y152C, K156M, C198R | 300 | 100.0 |
| N30D, K42E, N52S | 324 | −38.8 |
| N52S, F120S, I143V, I224V | 325 | −44.2 |
| N52S, E90A | 323 | −30.4 |
| N52H, N57Y, V110A, C198R, R221I | 317 | 100.0 |
| N52S, N194D | 366 | −22.3 |
| N52H, I143T | 135 | −78.0 |
| N52D | 111 | 0.5 |

E. Assessment of Proliferation and Intracellular Cytokine Markers by Flow Cytometry Carboxyfluorescein succinimidyl ester (CFSE) labeled pan T cells from MLR studies as described above that had been incubated for 4 days in the presence of wildtype or recombinant variant ICOSL ECD-Fc molecules were further tested for cytokine levels by restimulation with phorbol myristate acetate (PMA)/Ionomycin for 6 hours in the presence of golgi inhibitor (Golgi/Block/Plug). T cells from the MLR study that had been incubated with human IgG, anti-CD28, anti-ICOSL, PD-L2-Fc, or Belatacept (CTLA4-Fc containing L104E and A29Y mutations) also were restimulated. T cells were stained for CD4 or CD8 surface markers, fixed, permeabilized, and intracellularly stained for various cytokines as set forth in Table 24 and 25.

The percent (%) of CD4+ and CD8+ T cells that were positive for specific intracellular cytokines are shown in Table 24, respectively. The results showed that a number of the variant ICOSL ECD-Fc molecules were able to suppress one or more cytokines, including, in some cases, a majority of cytokines. A total score and mean score are calculated to assess the sum effects of individual molecules tested over the parameters examined in this assay. Proliferation was also assessed and a percentage of cells that have divided as determined by CFSE dilution is also shown in Table 24 and 25. Among the provided results, the results show that certain variants show comparable or better activity than Belatacept, particularly from the CD8+ cells.

TABLE 24

Assessment of Proliferation and Intracellular Cytokine levels of CD4+ T cells

| Variant SEQ ID NO (ECD) or Protein | Prolif | % Cytokine+ | | | | | | | | Total Score | Mean Score |
|---|---|---|---|---|---|---|---|---|---|---|---|
| | | % IFNg+ | % IL4+ | % IL21+ | % IL22+ | % TNF+ | % IL2+ | % IL10+ | % IL17A+ | | |
| 308 | 3.0 | 9.9 | 3.0 | 1.0 | 1.3 | 34.9 | 31.3 | 0.1 | 0.2 | 41.0 | 4.6 |
| 300 | 2.7 | 11.1 | 3.4 | 1.1 | 1.4 | 38.0 | 35.0 | 0.0 | 0.1 | 63.0 | 7.0 |
| 317 | 2.9 | 10.9 | 3.3 | 1.1 | 1.5 | 37.3 | 34.1 | 0.1 | 0.2 | 65.0 | 7.2 |
| 291 | 3.2 | 8.1 | 2.5 | 0.6 | 1.1 | 27.9 | 24.1 | 0.9 | 1.3 | 66.0 | 7.3 |
| 283 | 3.3 | 9.2 | 3.0 | 0.8 | 1.4 | 31.1 | 26.3 | 0.8 | 1.3 | 70.0 | 7.8 |
| 364 | 3.4 | 10.9 | 3.3 | 1.0 | 1.6 | 36.5 | 32.3 | 0.5 | 0.9 | 89.0 | 9.9 |
| 390 | 3.6 | 9.5 | 3.1 | 0.9 | 1.5 | 33.8 | 29.4 | 0.8 | 1.4 | 92.0 | 10.2 |
| 367 | 2.8 | 12.0 | 3.5 | 1.1 | 1.6 | 40.9 | 38.5 | 0.1 | 0.3 | 92.0 | 10.2 |
| CTLA-4-Ig: L104E, A29Y (Belatacept) | 10.7 | 10.5 | 2.7 | 2.4 | 2.0 | 24.5 | 19.6 | 0.6 | 1.4 | 99.0 | 11.0 |
| 112 | 3.5 | 12.0 | 3.8 | 1.3 | 1.6 | 41.3 | 36.7 | 0.2 | 0.4 | 109.0 | 12.1 |
| 285 | 4.4 | 9.8 | 3.2 | 1.2 | 1.7 | 32.7 | 29.3 | 0.9 | 1.4 | 114.0 | 12.7 |
| 113 | 3.0 | 13.2 | 4.1 | 1.2 | 1.8 | 43.2 | 39.8 | 0.1 | 0.2 | 115.0 | 12.8 |
| 365 | 3.6 | 11.3 | 3.9 | 1.0 | 2.0 | 39.1 | 34.6 | 0.8 | 1.3 | 118.0 | 13.1 |
| WT ICOSL | 12.7 | 16.7 | 5.8 | 4.9 | 4.7 | 36.2 | 29.2 | 0.2 | 0.4 | 127.0 | 14.1 |
| 113 | 3.5 | 12.3 | 3.9 | 1.1 | 1.8 | 39.2 | 37.5 | 0.4 | 0.6 | 127.0 | 14.1 |
| 366 | 10.9 | 16.0 | 7.2 | 4.9 | 5.4 | 40.6 | 33.0 | 0.1 | 0.2 | 135.0 | 15.0 |
| 321 | 10.6 | 16.7 | 6.0 | 4.3 | 5.0 | 41.3 | 37.3 | 0.2 | 0.3 | 146.0 | 16.2 |
| mIgG ctl | 15.5 | 15.6 | 5.9 | 5.2 | 4.6 | 31.7 | 26.0 | 0.4 | 1.7 | 146.0 | 16.2 |
| PDL2 | 12.3 | 17.9 | 5.7 | 4.7 | 5.2 | 41.4 | 36.0 | 0.3 | 0.6 | 163.0 | 18.1 |
| 323 | 11.9 | 17.7 | 6.2 | 5.2 | 5.3 | 42.4 | 37.5 | 0.2 | 0.4 | 167.0 | 18.6 |
| WT ICOSL | 12.8 | 17.4 | 6.3 | 5.4 | 5.6 | 38.9 | 32.1 | 0.3 | 0.6 | 167.0 | 18.6 |
| Anti-ICOSL | 15.5 | 16.3 | 6.5 | 5.2 | 5.5 | 35.1 | 29.1 | 0.7 | 2.0 | 168.0 | 18.7 |
| 135 | 12.6 | 17.4 | 6.5 | 5.4 | 4.9 | 44.3 | 37.2 | 0.4 | 0.5 | 179.0 | 19.9 |
| HuIgG | 12.7 | 17.1 | 6.3 | 5.9 | 4.9 | 41.1 | 32.4 | 0.7 | 1.3 | 181.0 | 20.1 |
| Anti-CD28 | 88.2 | 42.9 | 5.0 | 5.8 | 5.4 | 43.5 | 25.5 | 0.4 | 1.4 | 183.0 | 20.3 |
| 325 | 12.7 | 18.7 | 6.5 | 5.4 | 5.6 | 44.2 | 40.0 | 0.1 | 0.3 | 186.0 | 20.7 |
| 111 | 13.7 | 18.3 | 6.8 | 5.9 | 6.1 | 42.1 | 35.2 | 0.3 | 0.5 | 194.0 | 21.6 |

TABLE 25

Assessment of Proliferation andIntracellular Cytokine levels of CD8+ T cells

| Variant SEQ ID NO (ECD) or Protein | Prolif | % Cytokine+ | | | | | | | | Total Score | Mean Score |
|---|---|---|---|---|---|---|---|---|---|---|---|
| | | % IFNg+ | % IL4+ | % IL21+ | % IL22+ | % TNF+ | % IL2+ | % IL10+ | % IL17A+ | | |
| 308 | 4.2 | 8.4 | 1.6 | 2.2 | 47.2 | 7.6 | 8.0 | 0.2 | 0.1 | 67.0 | 7.4 |
| 300 | 3.8 | 8.5 | 2.0 | 2.2 | 47.2 | 8.1 | 9.1 | 0.1 | 0.0 | 69.0 | 7.7 |
| 317 | 3.9 | 8.8 | 2.0 | 1.7 | 45.6 | 8.4 | 9.0 | 0.1 | 0.1 | 64.0 | 7.1 |
| 291 | 3.8 | 7.0 | 1.4 | 1.8 | 46.6 | 5.9 | 5.9 | 1.1 | 1.1 | 78.0 | 8.7 |
| 283 | 4.3 | 8.4 | 1.9 | 1.7 | 50.2 | 7.1 | 6.6 | 1.1 | 1.1 | 98.0 | 10.9 |
| 364 | 4.1 | 9.0 | 1.8 | 1.8 | 46.4 | 8.2 | 8.5 | 0.7 | 0.8 | 87.0 | 9.7 |
| 390 | 4.1 | 7.9 | 1.8 | 1.8 | 49.8 | 7.3 | 7.2 | 1.0 | 1.2 | 93.0 | 10.3 |
| 367 | 3.5 | 9.0 | 1.7 | 2.0 | 47.3 | 8.6 | 10.4 | 0.2 | 0.2 | 78.0 | 8.7 |
| CTLA-4-Ig: L104E, A29Y (Belatacept) | 12.3 | 14.5 | 2.0 | 3.2 | 38.1 | 11.2 | 8.8 | 0.9 | 1.6 | 121.0 | 13.4 |
| 112 | 4.2 | 9.6 | 1.9 | 1.8 | 40.4 | 9.4 | 9.9 | 0.3 | 0.3 | 81.0 | 9.0 |
| 285 | 5.4 | 9.5 | 2.0 | 2.7 | 44.2 | 7.8 | 8.4 | 1.2 | 1.3 | 112.0 | 12.4 |
| 113 | 3.7 | 9.5 | 1.9 | 1.3 | 44.4 | 9.4 | 10.5 | 0.1 | 0.1 | 62.0 | 6.9 |
| 365 | 4.1 | 9.6 | 2.3 | 1.8 | 46.8 | 9.0 | 9.3 | 0.9 | 1.0 | 122.0 | 13.6 |
| ICOSL | 17.2 | 22.3 | 4.9 | 6.4 | 46.4 | 22.0 | 15.7 | 0.4 | 0.7 | 181.0 | 20.1 |
| 113 | 4.2 | 9.5 | 2.0 | 2.1 | 45.6 | 8.9 | 10.7 | 0.5 | 0.5 | 110.0 | 12.2 |
| 366 | 14.5 | 19.4 | 5.6 | 4.8 | 48.4 | 19.2 | 13.8 | 0.1 | 0.2 | 142.0 | 15.8 |
| 321 | 13.4 | 18.9 | 4.3 | 5.0 | 46.3 | 18.4 | 15.4 | 0.3 | 0.6 | 138.0 | 15.3 |
| mIgG ctl | 20.2 | 25.0 | 4.4 | 4.1 | 35.5 | 24.6 | 15.8 | 0.7 | 1.8 | 174.0 | 19.3 |
| PDL2 | 15.6 | 21.2 | 4.1 | 4.8 | 44.1 | 20.7 | 15.6 | 0.5 | 0.8 | 147.0 | 16.3 |

TABLE 25-continued

Assessment of Proliferation andIntracellular Cytokine levels of CD8+ T cells

| Variant SEQ ID NO (ECD) or Protein | Prolif | % Cytokine+ | | | | | | | | Total Score | Mean Score |
|---|---|---|---|---|---|---|---|---|---|---|---|
| | | % IFNg+ | % IL4+ | % IL21+ | % IL22+ | % TNF+ | % IL2+ | % IL10+ | % IL17A+ | | |
| 323 | 15.4 | 20.8 | 4.7 | 5.6 | 44.9 | 20.6 | 17.1 | 0.2 | 0.5 | 149.0 | 16.6 |
| WT ICOSL | 17.5 | 22.1 | 5.5 | 4.6 | 45.0 | 21.0 | 12.8 | 0.2 | 0.4 | 148.0 | 16.4 |
| Anti-ICOSL | 21.5 | 26.4 | 4.8 | 5.3 | 33.4 | 26.9 | 19.0 | 1.0 | 2.3 | 198.0 | 22.0 |
| 135 | 17.2 | 22.2 | 4.7 | 6.7 | 39.4 | 22.5 | 18.1 | 0.8 | 0.9 | 178.0 | 19.8 |
| HuIgG | 15.9 | 21.5 | 4.4 | 6.4 | 41.6 | 21.4 | 15.1 | 1.4 | 1.7 | 179.0 | 19.9 |
| Anti-CD28 | 60.6 | 44.3 | 3.5 | 2.1 | 38.6 | 32.5 | 16.0 | 1.2 | 1.6 | 182.0 | 20.2 |
| 325 | 16.5 | 22.0 | 4.9 | 5.4 | 44.0 | 21.9 | 18.5 | 0.2 | 0.6 | 161.0 | 17.9 |
| 111 | 17.7 | 22.8 | 5.3 | 6.1 | 45.4 | 22.9 | 16.7 | 0.4 | 0.6 | 183.0 | 20.3 |

Example 16

Assessment of Cytokine Production in B-T Cell Co-culture

B cells and CD4+ T cells were purified from the same donor and labeled with CSFE and plated in 96 well plates in 1:1 cellular ratios at 5×10⁴ cells of each per well. Variant ICOSL ECD-Fc fusion molecules or Belatacept were added at a final concentration of 40 nM per well. Cells were either unstimulated or incubated with 100 ng/mL of Staphylococcus enterotoxin B (SEB), 1 µg/mL of Pokeweed Mitogen (PWM) or both for 7 days at 37° C. in a final volume of 200 µl/well.

Cells were harvested and surface stained for the following B and T cell lineage markers (IgM, IgD, CD38, CD138, CD27, CD19, CD4, CD3). Proliferation was assessed by flow cytometry and culture supernatants were analyzed for IL-5, IL-13 or IL-21 cytokines using a LEGENDplex human Th cytokine detection kit (Biolegend, USA).

Figures 6A, 6B:
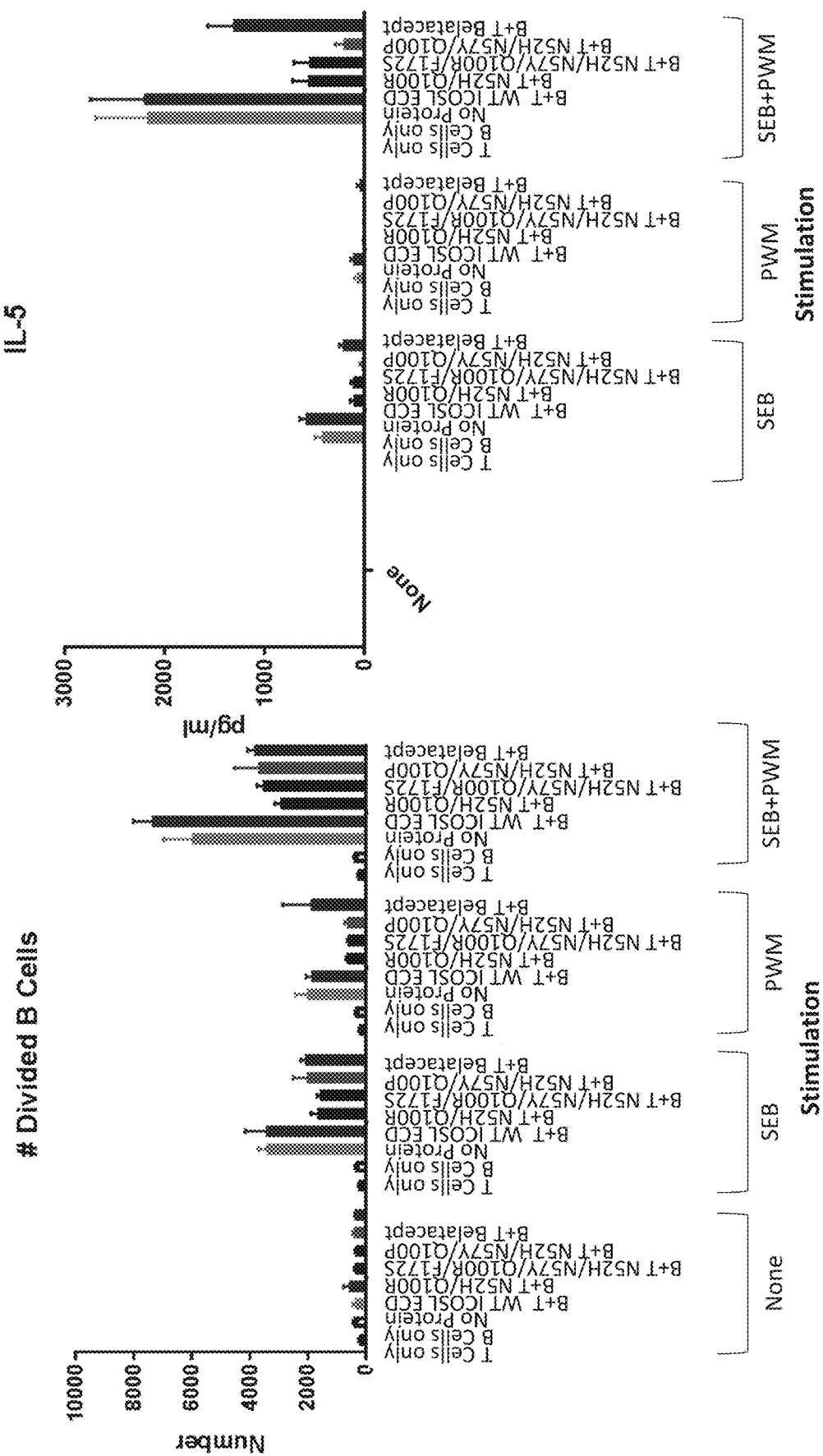
FIGS. 6A-6D depicts the inhibition of soluble ICOSL Fc-fusion proteins on B and T cell responses in a B-T co-culture assay.
Figures 6C, 6D:
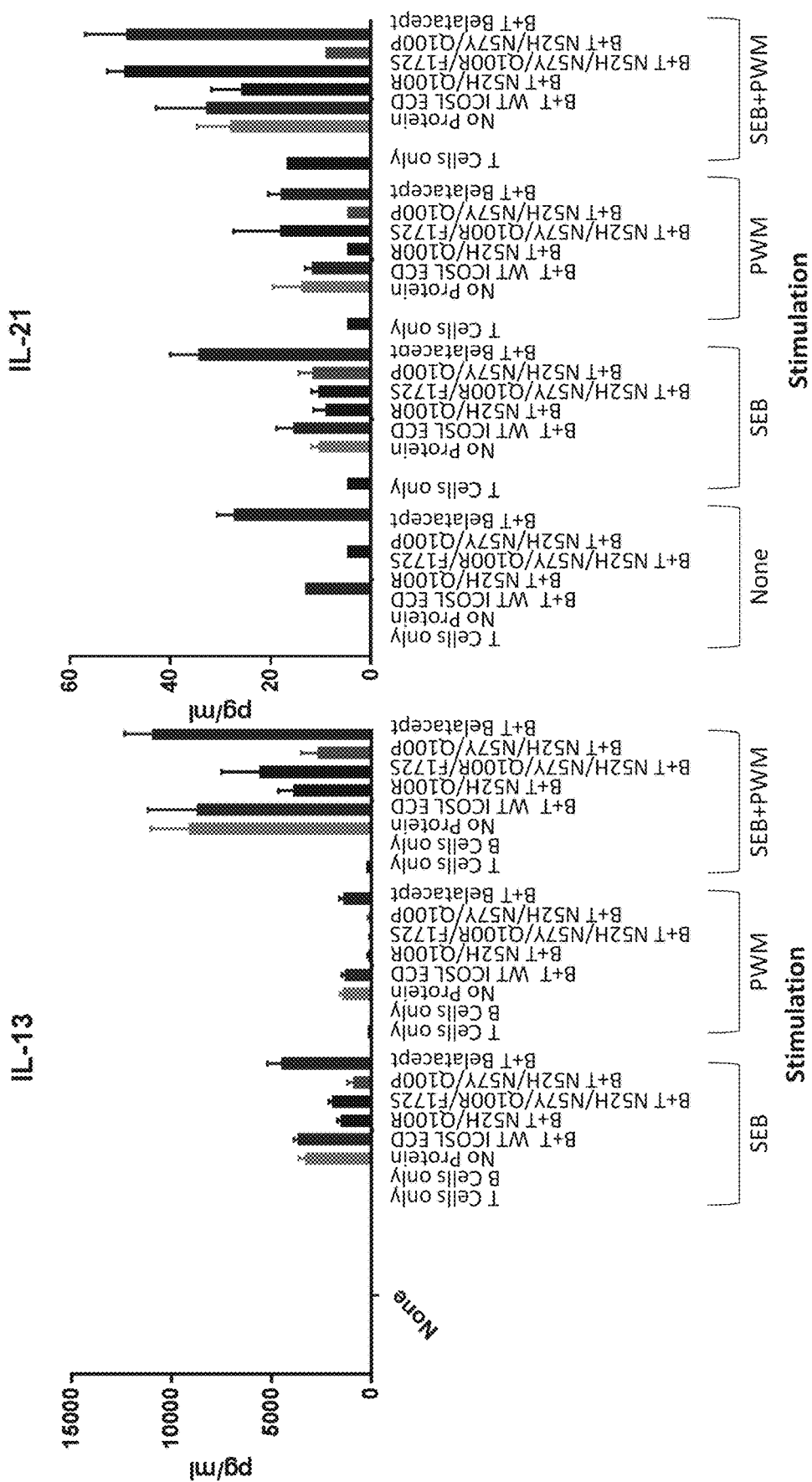

As shown in FIG. 6A, the number of dividing B cells was reduced in B/T cell co-cultures when incubated in the presence of variant ICOSL ECD Fc-fusion molecules compared to no protein controls. The degree of antagonistic effect for the tested exemplary variants was similar to CTLA-4-Ig Belatacept (L104E, A29Y). Likewise, as shown in FIGS. 6B-6D, variant ICOSL ECD Fc-fusion molecules inhibited cytokine production in primary human B cell/T cell coculture in vitro compared to no protein controls as well as cultures containing wild-type ICOSL control. Compared to Belatacept, exemplary tested variant ICOSL ECD Fc-fusion molecules were more effective in blocking cytokine production in some cases.

Example 17

Assessment of Survival and Disease Activity in Graft-Versus-Host-Disease (GvHD) Model Exemplary ICOSL variant ECD-Fc protein, were assessed for activity in a graft-versus-host-disease (GvHD) model. Female NSG mice (n=10 per group) were irradiated (100 rad) and administered 10 mg of gamma globulin subcutaneously on Day −1. On Day 0, the mice received 10 million human peripheral blood mononuclear cells (PBMCs) and intraperitoneal injection dosing of either 100 µg of WT-ICOSL ECD Fc, a variant ICOSL ECD Fc molecule N52H/I143T (ECD set forth in SEQ ID NO: 135), a variant ICOSL ECD Fc molecule N52H/N57Y/Q100P (ECD set forth in SEQ ID NO: 113), 75 µg of Belatacept (CTLA-4-Ig L104E/A29Y; U.S. Patent Application Publication Number US20160271218) or saline as control. On Day 15, engrafted human CD45+ cells were phenotyped by flow cytometry. After the study was terminated on Day 35, endpoint measurements of survival, body weight loss, and disease activity were evaluated.

Figure 7A:
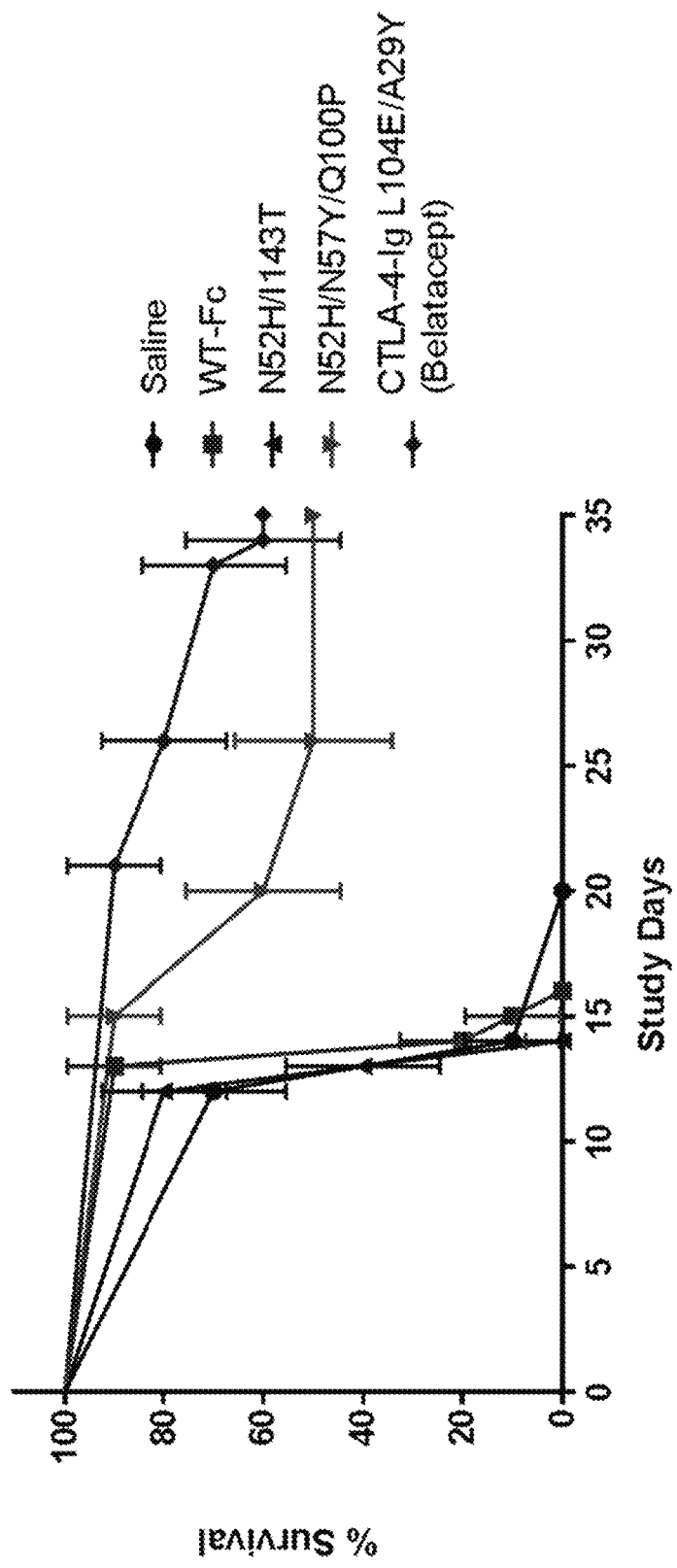
FIGS. 7A-7F depicts different endpoints in a mouse model of Graft Verse Host Disease (GVHD) where human PBMC cells were adoptively transferred into immunodeficient NSG murine hosts.
Figure 7B:
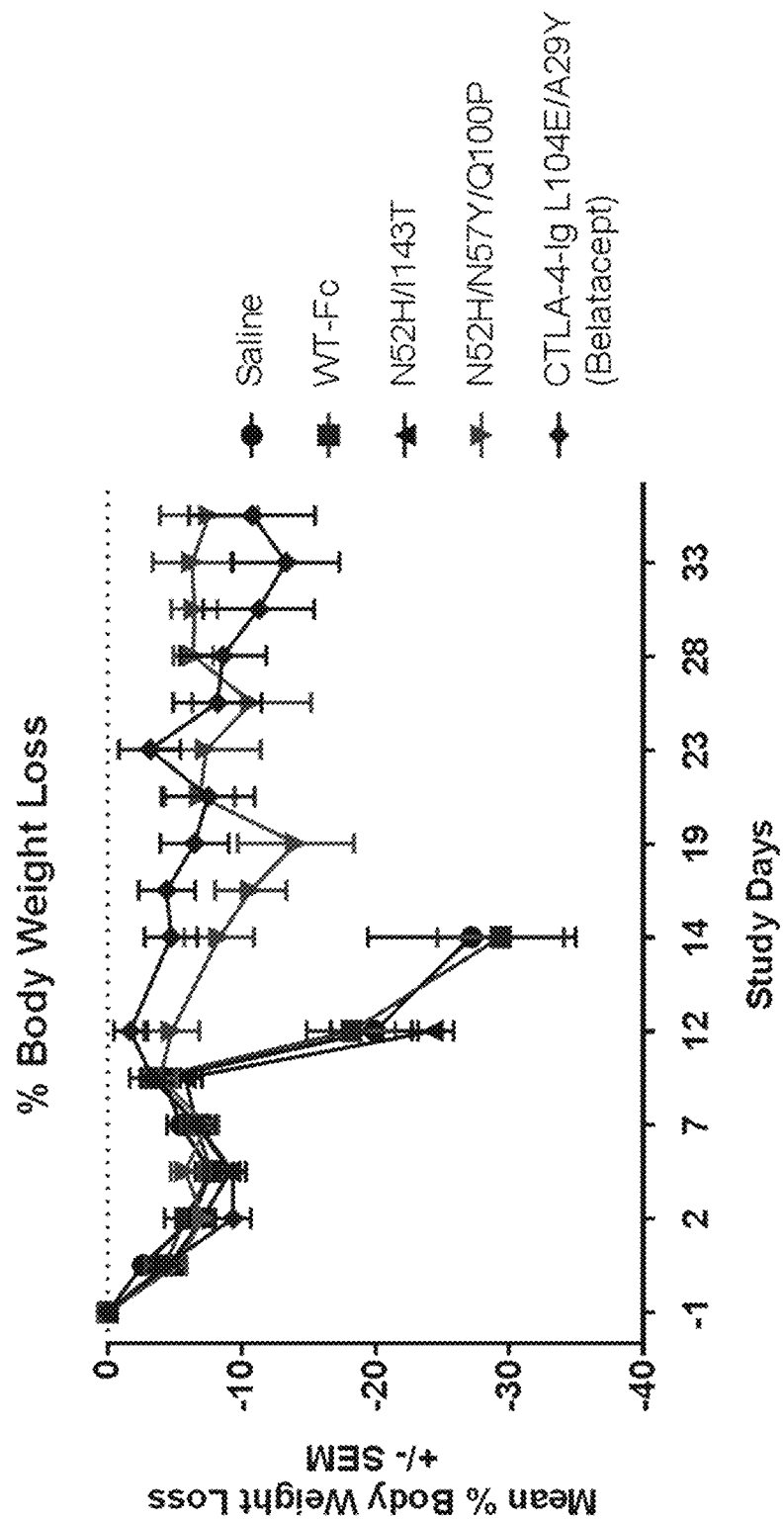

FIG. 7A shows the survival of GVHD mice treated with saline, WT ICOSL-ECD Fc, the variant ICOSL ECD-Fc molecules, or Belatacept. A significant difference in the survival of mice administered variant ICOSL ECD-Fc N52H/N57Y/Q100P (ECD set forth in SEQ ID NO: 113) compared to mice administered saline or WT ICSOL ECD-Fc was observed (p<0.0001 by Mantel-Cox and Gehan-Breslow-Wilcoxon tests). FIG. 7B shows similar differences between the body weight loss of mice treated with saline, WT ICOSL ECD-Fc, the variant ICOSL ECD-Fc molecules, or Belatacept over the course of the study.

Figure 7C:
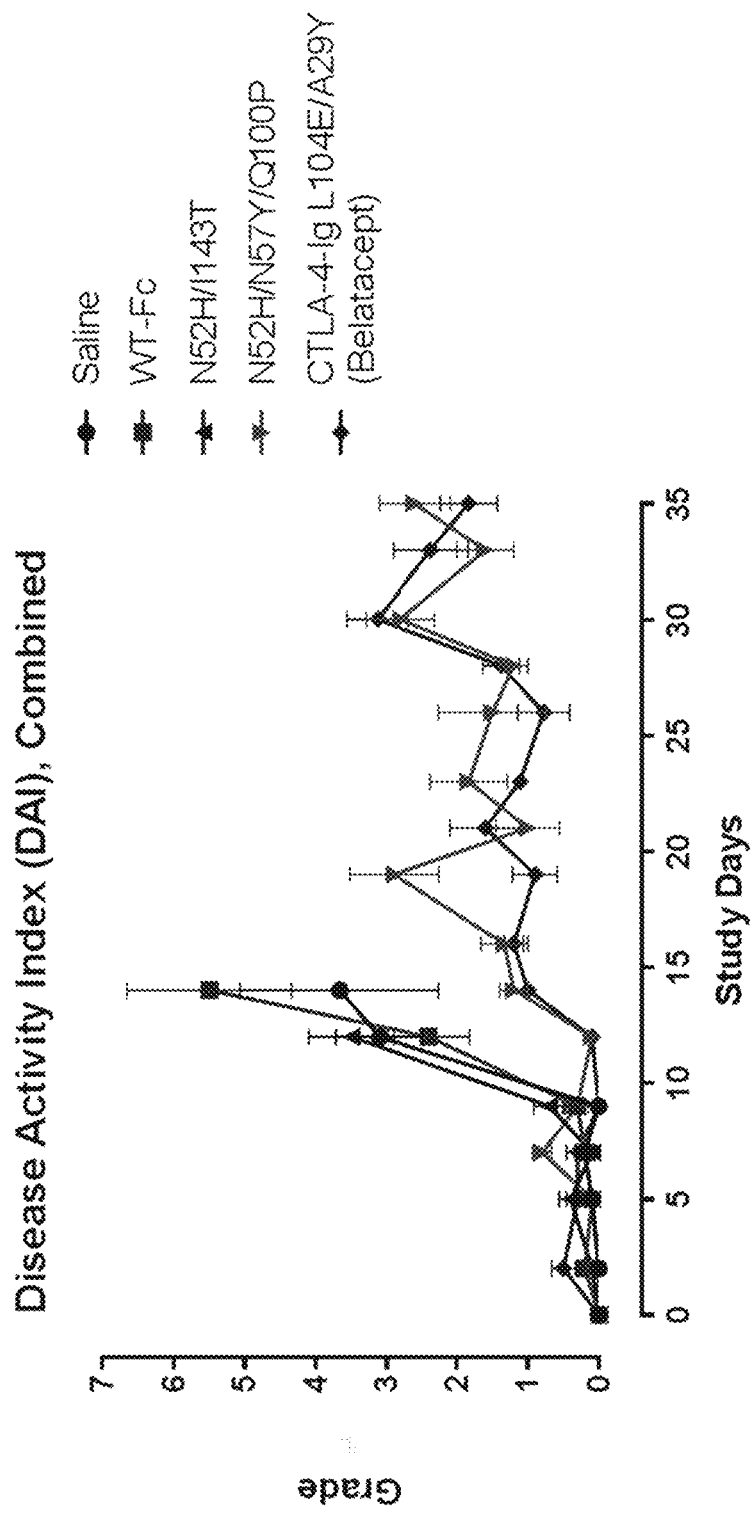
Figure 7D:
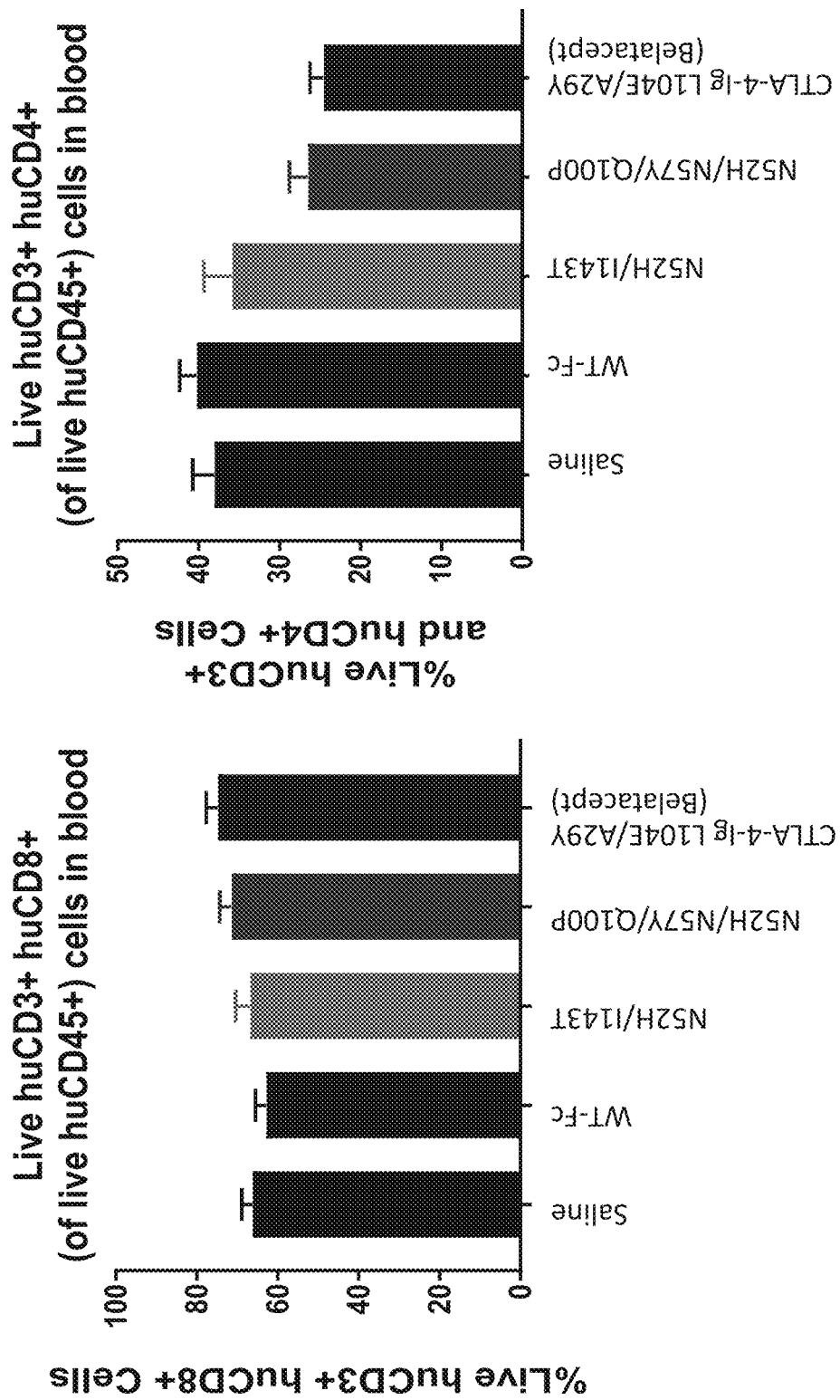

A disease activity index (DAI) was determined three times a week during the study and evaluated the scoring of weight loss, posture, activity, appearance of the hair coat and skin of the mice. The grade of disease over the course of the study is shown in FIG. 7C. Treatment groups that received ICOSL Fc variant N52H/N57Y/Q100P (ECD set forth SEQ ID NO: 113) or Belatacept showed significantly improved DAI scores. The percentage of human T cells in the peripheral blood on day 14 of the study was also assessed by flow cytometry. Measurements were averaged by treatment group and error bars represent standard error of the mean (SEM). FIG. 7D shows the percent of live CD3+/CD4+ or CD3+/CD8+ cells in the blood. Treatment groups that received variant ICOSL ECD Fc with N52H/N57Y/Q100P (ECD set forth SEQ ID NO: 113) or Belatacept showed significantly different levels of CD4+ T cells compared to saline treatment group (p=0.008 and 0.006, respectively, by unpaired t-test). This study demonstrates the therapeutic effect of the variant ICOSL Fc variant protein on human primary T cells and GVHD during in vivo modeling.

Figure 7E:
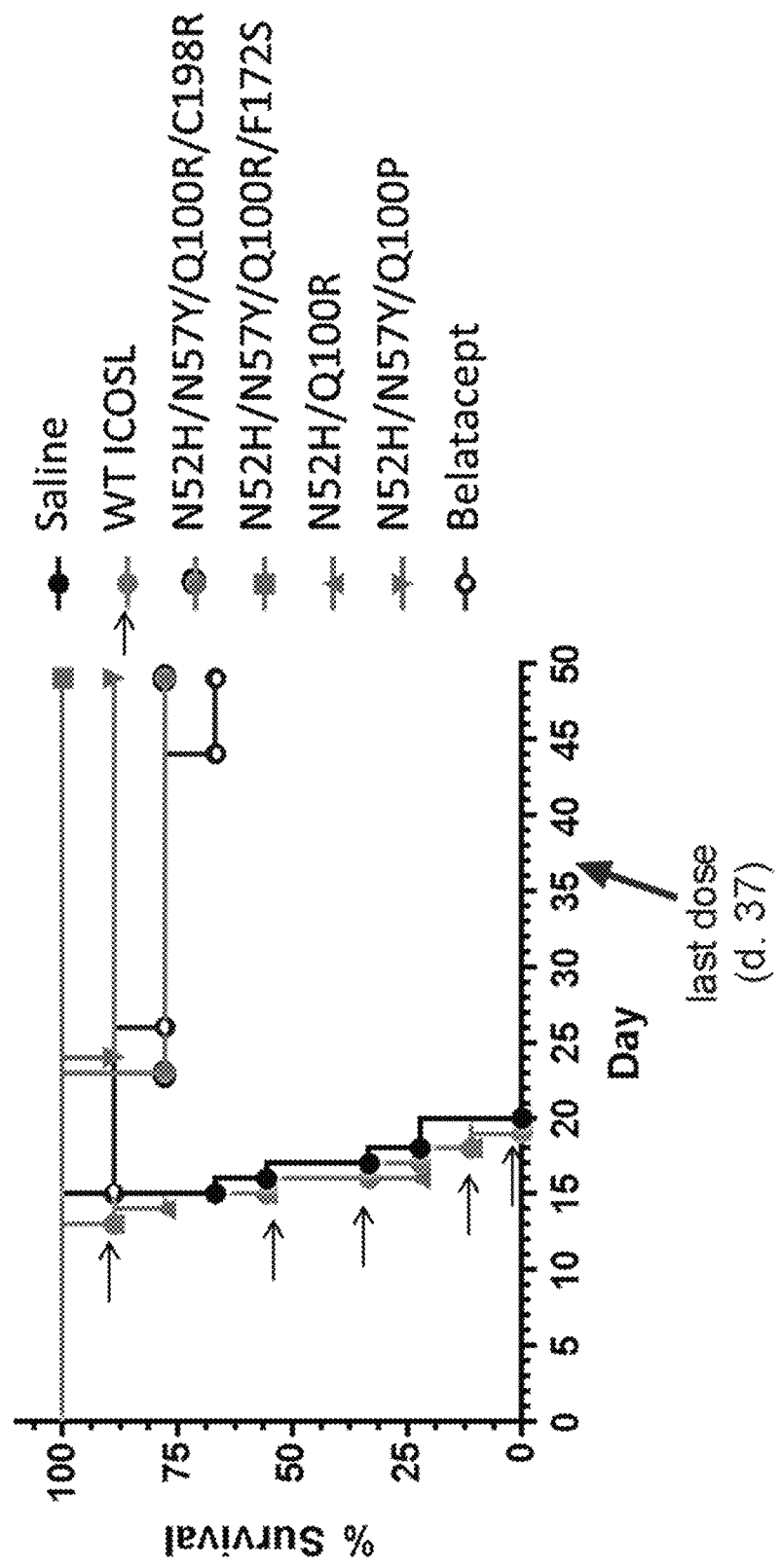
Figure 7F:
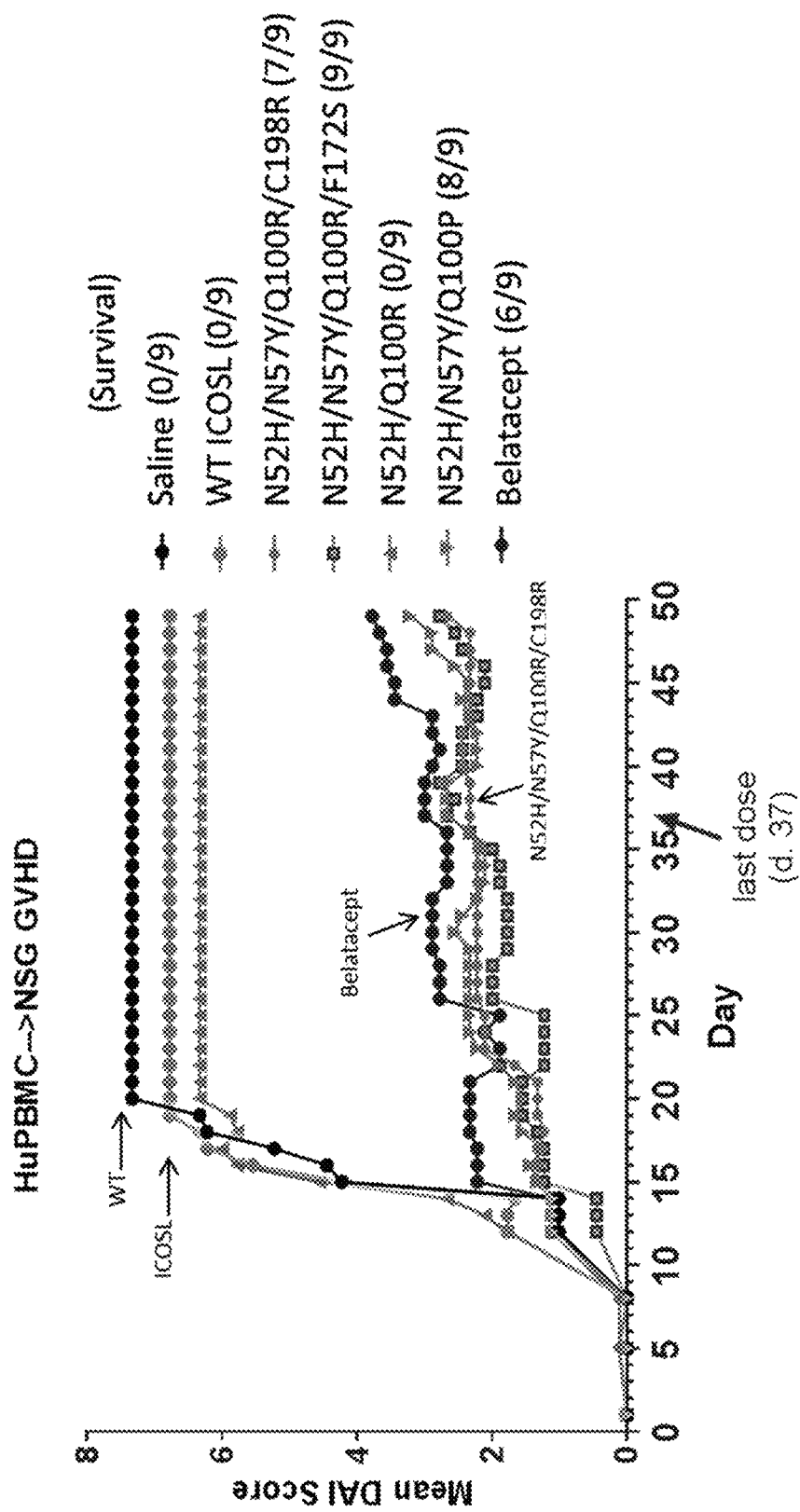

A similar study with additional variant ICOSL ECD-Fc fusion molecules was carried out including variant ICOSL ECD-Fc N52H/N57Y/Q100R/C198R (ECD set forth in SEQ ID NO: 365), N52H/N57Y/Q100R/F172S (ECD set forth in SEQ ID NO: 291), and N52H/N57Y/Q100P (ECD set forth in SEQ ID NO: 288). N52H/Q100R (ECD set forth in SEQ ID NO: 285), which had reduced activity in the in vitro MLR studies as shown above, also was tested. NSG mice (n=9/group) were treated as described above. In this study, dosing with the ICOSL-Fc or Belatacept continued 3 times per week from day 0 through day 37 and surviving mice were terminated on day 49. To determine statistical differences in survival proportions among groups, data were analyzed using the Mantel-Cox (log-rank) test. The resulting survival curves are shown in FIG. 7E. Belatacept and ICOSL-Fc variants N52H/N57Y/Q100R/C198R (ECD set forth in SEQ ID NO: 365), N52H/N57Y/Q100R/F172S (ECD set forth in SEQ ID NO: 291), and N52H/N57Y/Q100P (ECD set forth in SEQ ID NO: 288) significantly prolonged survival as compared to saline and WT ICOSL-Fc (p<0.001). The mean DAI scores were plotted for the time course of the experiment, with the last observation (i.e. mean scores collected on days of termination) carried forward on the graph for those groups terminated prior to the last planned study day (Day 49). Significant differences among groups for data over time (i.e. DAI scores) were determined using 2-way repeated measures ANOVA for 'treatment' effects. The resulting DAI scores are shown in FIG. 7F. Belatacept and ICOSL-Fc variants N52H/N57Y/Q100R/C198R (ECD set forth in SEQ ID NO: 365), N52H/N57Y/Q100R/F172S (ECD set forth in SEQ ID NO: 291), and N52H/N57Y/Q100P (ECD set forth in SEQ ID NO: 288) significantly reduced DAI scores as compared to saline and WT ICOSL-Fc (p<0.001), and between Belatacept and ICOSL-Fc variant with N52H/N57Y/Q100R/C198R by 2-way ANOVA for DAI scores (p=0.035).

The activity of the variant ICOSL-Fc, in some cases, was improved compared to treatment with belatacept. Administration of ICOSL-Fc variants protected from effects of GVHD, as evidenced by enhanced survival and attenuated disease development, at levels comparable to or better than belatacept. The activity in this model correlated with in vitro activity, since WT ICOSL-Fc and variant ICOSL-Fc with mutations N52H/Q100R (ECD set forth in SEQ ID NO: 285) were not as effective in this model.

Example 18

Assessment of Activation by Stacked Molecules

Stacked variant IgV Fc fusion proteins containing an NKp30 IgV domain as a localizing domain (designated "L") and an ICOSL IgV domain as a costimulatory domain (designated "C") were generated and assessed substantially as described in Example 8. Specifically, the constructs tested in this experiment include: (1) a stacked construct with variant IgV Fc fusion protein (vIgD C-L) containing an NKp30 composed of Ig of consensus NKp30 variant (SEQ ID NO:143) with the IgV domain of ICOSL variant N52H/N57Y/Q100P (ECD set forth in SEQ ID NO: 113 and IgV set forth in SEQ ID NO:201); (2) a stacked construct with the NKp30 wildtype domain Ig domain (SEQ ID NO:214) and V domain of wildtype ICOSL (WT C-L) (SEQ ID NO:196); (3) a construct with wild-type ICOSL IgV domain (WT C domain; SEQ ID NO:196), and (3) a construct with the wildtype NKp30 domain (WT L domain; SEQ ID NO: 214).

CD32+K562 cells were engineered to stably express B7-H6 on the cell surface. The cells were then treated with mitomycin and plated with pan T-cells in the presence of absence of 10 nM anti-CD3 and stacked variants or control domains at 100, 33, 11, or 3.7 nM. Cells were cultured 3 days before harvesting culture supernatants and measuring human IFN-gamma levels using an ELISA.

Figure 8:
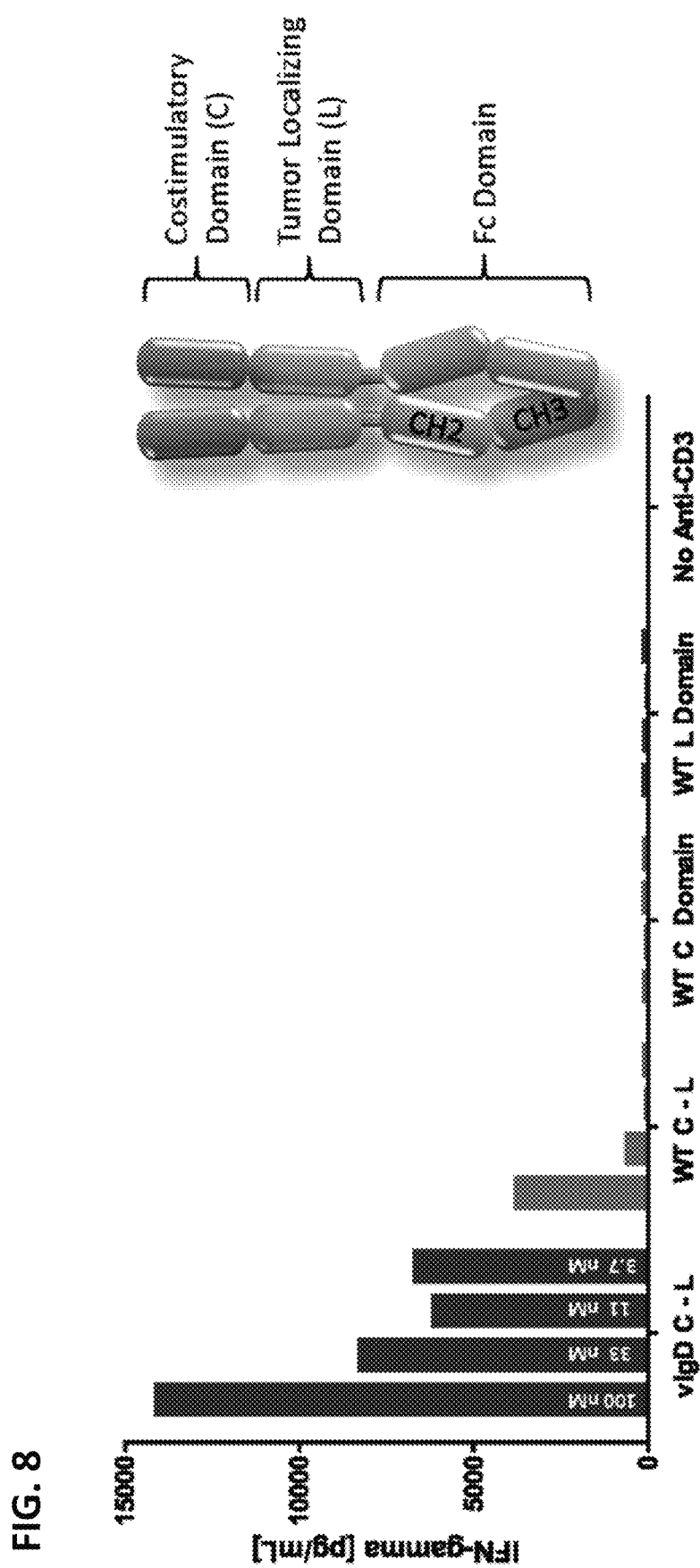
FIG. 8 shows localized costimulatory activity conveyed by the indicated variant stack molecule vIgD C-L, where C represents an ICOSL costimulatory domain and L represents a NKp30 localizing domain. In this assay, target K562 cells expressing the localizing surface protein, B7-H6, were cultured in the presence of anti-CD3 with human T cells and T cell activation was assessed by IFN-gamma levels in culture supernatants. Including anti-CD3 alone or no stack variant Fc molecules did not induce T cell activation. Similarly, cells cultured with only the wild-type localizing NKp30 domain alone or the wild-type costimulatory ICOSL domain alone as Fc fusion proteins did not result in T cell activation. A stacked domain containing the wild-type version of both the costimulatory domain and localizing domain induced measurable IFN-gamma at the highest concentration tested, however, the variant localizing costimulatory stack induced greater than two fold higher IFN-gamma levels at the highest concentration, and IFN-gamma levels that were still observed as the concentrations were titrated down.

As shown in FIG. 8A, both variant and wildtype costimulatory-localizing domain stacks were able to localize to the engineered K562 cells and deliver a co-stimulatory signal to the pan-T-cells to induce IFN-gamma secretion. The stacked construct with variant IgV Fc fusion protein (vIgD C-L) showed increased functional activity results at all concentrations tested, while the individual domain components had no effect when not combined with each other.

Example 19

Assessment of Delayed Type Hypersensitivity In Vivo

Variant ICOSL ECD-Fc fusion molecules were assessed for anti-inflammatory activity in vivo in the mouse delayed-type hypersensitivity (DTH) model. Delayed-type hypersensitivity immune reactions were elicited in ovalbumin (OVA)-sensitized mice and response after challenge was assessed. The variant ICOSL ECD-Fc fusion molecules tested contained a variant ECD with the following amino acid substitutions: N52H/N57Y/Q100P (ECD set forth in SEQ ID NO: 113), N52H/Q100R (ECD set forth in SEQ ID NO: 285), or N52H/N57Y/Q100R/F172S (ECD set forth in SEQ ID NO: 291). The variants were fused to either an Fc backbone containing mutations C220S/L234A/L235E/G237A by EU numbering (designated Fc #1) set forth in SEQ ID NO: 477) or an Fc backbone containing mutations C220S/E233P/L234V/L235A/G236del/S267K by EU numbering (designated Fc #2) set forth in SEQ ID NO:478) either with or without a G4S (GGGGS; SEQ ID NO: 636) linker. Table 26 sets forth the tested constructs:

TABLE 26

| ICOSL ECD-Fc Fusion Constructs | | | |
|---|---|---|---|
| | ICOSL ECD (SEQ ID NO) | G4S Linker | Fc (SEQ ID NO) |
| N52H/N57Y/Q100P (G4S)-Fc #1 | 113 | + | 477 |
| N52H/Q100R (G4S)-Fc #1 | 285 | + | 477 |
| N52H/N57Y/Q100R/ F172S (G4S)-Fc | 291 | + | 478 |
| N52H/N57Y/Q100R/ F172S (G4S)-Fc | 291 | + | 477 |
| N52H/N57Y/Q100R/ F172S-Fc | 291 | − | 477 |

For sensitization, 8-week old female BALB/c mice were injected subcutaneously with 100 µg of OVA emulsified in Sigma Adjuvant (100 µL; catalog number 56322-1VL) at the base of the tail on day 0. On days 1 and 4, the mice were administered variant ICOSL ECD-Fc fusion proteins, 75 µg of CTLA-4 Fc (abatacept), or PBS as negative control by intraperitoneal injection. On day 7 at two to three hours prior to OVA challenge, the mice were further administered PBS as a control, 75 µg of CTLA-4 Fc (abatacept from Orencia), or the indicated variant ICOSL polypeptide by intraperitoneal injection. Abatacept and variant ICOSL-Fc fusion molecules were dosed at molar equivalents.

For OVA challenge, an intradermal injection of 10 µg OVA in the left ear pinnae in a 10 µL volume of PBS was delivered under gas isoflurane anesthesia 2-3 hours following therapeutic treatment. Baseline ear thickness was measured prior to OVA challenge.

Figure 9:
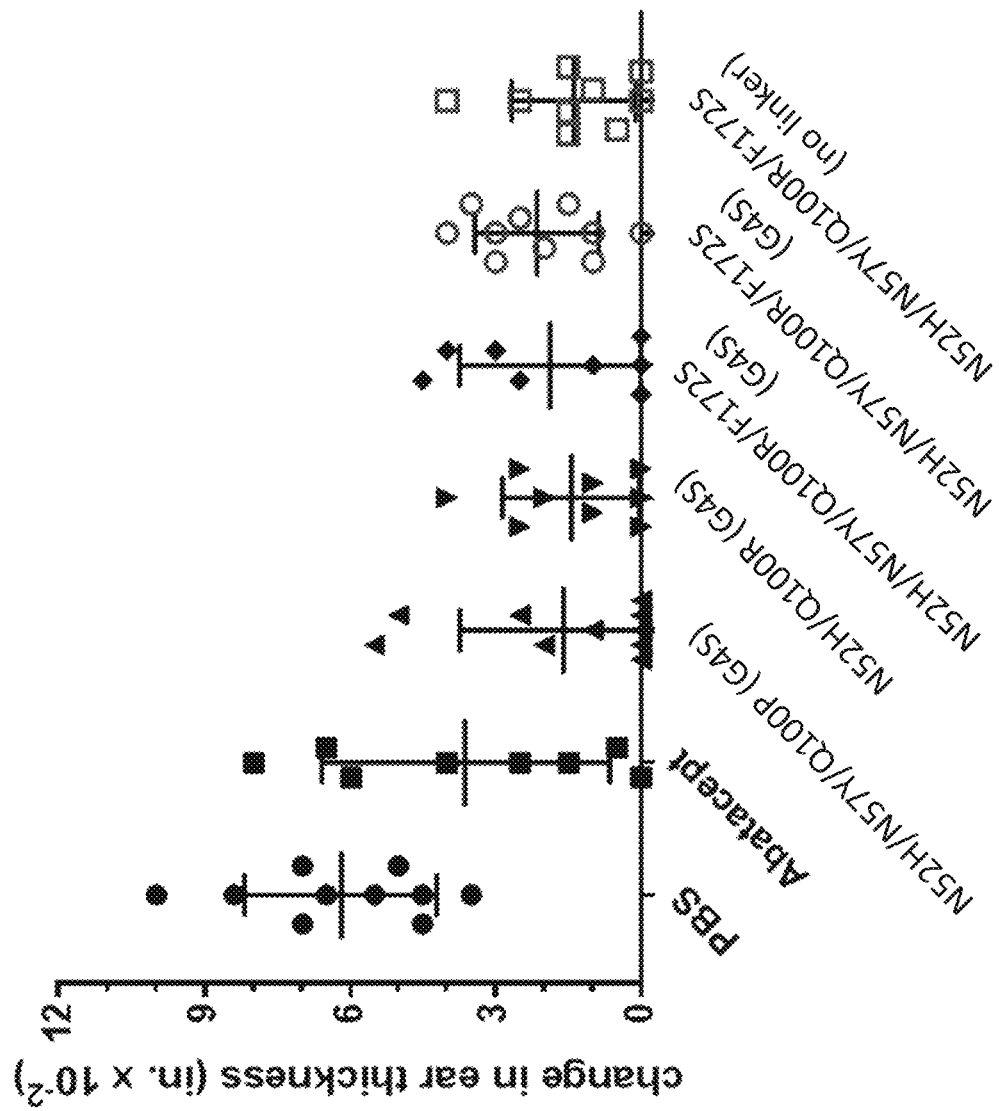
FIG. 9 summarizes changes in ear thickness in mice from a standard model of Delayed-Type Hypersensitivity (DTH). PBS treated animals sensitized with ovalbumin and subsequently challenged in the ear with the same protein, show the highest level of measured ear swelling. Mice treated with clinical benchmark Abatacept have slightly reduced ear swelling following ear challenge. All five ICOSL variant treatment groups demonstrated equal or improved reductions in ear swelling compared to Abatacept.

On day 8, ear thickness was measured under isoflurane anesthesia using Mitutoyo calipers and the change in ear thickness before and after OVA challenge was determined. As shown in FIG. 9, mice treated with the indicated variant ICOSL ECD-Fc fusion molecules showed significantly less OVA-induced ear swelling as compared to PBS control (<0.0001 by 1-way ANOVA). There were no significant differences between ear thickness for mice treated with abatacept compared to any of the indicated variant ICOSL ECD-Fc fusion molecules tested or between the variant ICOSL treatments. These results demonstrate that variant ICOSL molecules can reduce immune responses in vivo.

Example 20

Generation and Assessment of Binding and Activity of Variant ICOSL IgSF Domain-Containing Molecules Additional variant ICOSL IgSF (e.g. ECD) domain-containing molecules were generated, as described below. In each of the Tables below, the Table indicates amino acid substitutions in the ECD of the variant ICOSL as designated by amino acid position number corresponding to amino acid positions in the respective reference (e.g., unmodified) ICOSL extracellular domain (ECD) sequence set forth in SEQ ID NO:32. In some cases, the removal of the AAA linker sequence of the variant ICOSL ECD-Fc is indicated by "ΔAAA". Column 2 sets forth the SEQ ID NO identifier for each variant ECD domain contained in the variant ECD-Fc fusion molecule.

A. Generation of Additional Variants

1. Solubility Variants

From a collection of mutants containing the following mutations including E16V, N30D, K42E, N52H, N52Y, N52S, N57Y, E90A, Q100R, Q100P, L102R, V110D, H115R, F120S, V122A, F138L, I143V, I143T, H152C, K156M, F172S, N194D, C198R, L203P, R221I, I224V, the mutations H115R, F172S and C198R were identified as mutations that may potentially enhance protein solubility or enhance protein expression ('solubility mutations'). These three mutations (H115R, F172S and C198R) were randomly introduced by site directed mutagenesis into the same set of clones to generate a collection of derivatives that contain one or more of these solubility mutations. Because site directed mutagenesis reaction was carried out with pooled mutagenic oligos reacted with pooled parental clones in a single reaction, some of the clones also contain some mutations from other parental clones. The generated variants contained between 3 to 10 different amino acid mutations in various combinations, as summarized in Table 27A.

TABLE 27A

Exemplary variant ICOSL polypeptides

| Mutation(s) | ECD SEQ ID NO |
|---|---|
| Wild-type | 32 |
| N52H/N57Y/Q100R/H115R/C198R | 435 |
| N52H/N57Y/Q100R/F172S/C198R | 436 |
| N52H/N57Y/Q100R/H115R/F172S/C198R | 437 |
| N52H/N57Y/Q100R/H115R/I143V/F172S/C198R | 438 |
| N52H/N57Y/Q100R/L102R/H115R/F172S/C198R | 439 |
| N52H/V122A/F172S/C198R | 440 |
| N52H/N57Y/Q100R/H115R/F172S/N194D | 441 |
| N52H/N57Y/H115R/F172S/C198R | 442 |
| N52H/N57Y/Q100R/H115R/C198R | 443 |
| N52H/N57Y/H115R | 444 |
| N52H/N57Y/Q100R/H115R | 445 |
| N52H/N57Y/Q100R/H115R/F172S/I224V | 446 |
| N52H/N57Y/Q100R/H115R/F172S | 447 |
| N52H/N57Y/Q100R/F172S | 448 |
| N52H/Q100R/H115R/I143T/F172S | 449 |
| N52H/N57Y/Q100P/H115R/F172S | 450 |
| N52Y/N57Y/Q100P/F172S | 451 |
| E16V/N52H/N57Y/Q100R/V110D/H115R/C198R | 452 |

TABLE 27A-continued

Exemplary variant ICOSL polypeptides

| Mutation(s) | ECD SEQ ID NO |
|---|---|
| E16V/N52H/N57Y/Q100R/V110D/H115R/Y152C/K156M/F172S/C198R | 453 |
| N52S/E90A/H115R | 454 |
| N30D/K42E N52S/H115R | 455 |
| N30D/K42E/N52S/H115R/C198R/R221I | 456 |
| N30D/K42E/N52S/H115R/C198R | 457 |
| N30D/K42E/N52S/H115R/F172S/N194D | 458 |
| N52S/H115R/F120S/I143V/C198R | 459 |
| N52S/H115R/F172S/C198R | 460 |
| N52H/N57Y/Q100P/C198R | 461 |
| N52H/N57Y/Q100P H115R/F172S/C198R | 462 |
| N52H/N57Y/Q100P/F172S/C198R | 463 |
| N52H/N57Y/Q100P/H115R | 464 |
| N52H/N57Y/Q100P/H115R/C198R | 465 |
| N52H/Q100R/C198R | 466 |
| N52H/Q100R/H115R/F172S | 467 |
| N52H/Q100R/H115X/F172S/C198R | 468 |
| N52H/Q100R/H115R/F172S/C198R | 469 |
| N52H/N57Y/Q100R/F172S/C198R | 470 |

2. Back Variants

Particular exemplary mutations including N52H, N52Y, N57Y, Q100R, Q100P, F138L, C198R, L203P identified in select variants described in Example 6 were further combined in the ECD of the reference (e.g., wild-type) ICOSL with reference to positions set forth in SEQ ID NO: 32 to generate additional combination variants. The generated variants contained between 1 to 3 different amino acid mutations in various combinations as set forth in Table 27B.

TABLE 27B

Exemplary variant ICOSL polypeptides

| Mutation(s) | ECD SEQ ID NO |
|---|---|
| Wild-type | 32 |
| Q100R | 427 |
| F138L/L203P | 428 |
| N52Y/F138L/L203P | 429 |
| N57Y/Q100R/C198R | 430 |
| N57Y/F138L/L203P | 431 |
| N52H | 110 |
| N57Y | 121 |
| N57Y/Q100P | 122 |
| Q100R/F138L | 432 |
| L203P | 433 |

3. Glycosylation Variants

Exemplary glycosylation mutations selected from N52H, N52Q, N84Q, N119Q, N155H, N155Q, N168Q, N207Q were combined in various permutations in the ECD of the reference (e.g., wild-type) ICOSL with reference to positions set forth in SEQ ID NO:32 to generate additional combination variants. The generated variants contained between 1 to 5 different amino acid mutations in various combinations as set forth in Table 27C. Mutations designated with an "X" indicate either an N or Q at the indicated position.

TABLE 27C

(glyc): Exemplary variant ICOSL polypeptides

| Mutation(s) | ECD SEQ ID NO |
|---|---|
| Wild-type | 32 |
| N84Q | 387 |
| N119Q | 388 |
| N168Q | 389 |
| N207Q | 390 |
| N52Q/N207X | 391 |
| N168X/N207X | 392 |
| N52Q/N168Q | 393 |
| N84Q/N207Q | 394 |
| N155Q/N207Q | 395 |
| N119Q/N168Q | 396 |
| N119Q/N207Q | 397 |
| N119Q/N155X | 398 |
| N52Q/N84Q | 399 |
| N52Q/N119Q | 400 |
| N84Q/N119Q | 401 |
| N52Q/N84Q/N168Q | 402 |
| N52Q/N84Q/N207Q | 403 |
| N84Q/N155Q/N168Q | 404 |
| N84Q/N168Q/N207Q | 405 |
| N84Q/N155H/N207Q | 406 |
| N155Q/N168Q/N207Q | 407 |
| N119Q N155Q/N168Q | 408 |
| N119Q/N168Q/N207Q | 409 |
| N84Q/N119Q/N207Q | 410 |
| N119Q/N155H/N207Q | 411 |
| N84Q/N119Q/N155Q | 412 |
| N52Q/N119Q/N155Q | 413 |
| N52H/N84Q/N119Q | 414 |
| N52H/N84Q/N168X/N207X | 415 |
| N52Q/N84Q/N155X/N168X | 416 |
| N52Q/N84Q/N119Q/N168Q | 417 |
| N84Q/N119Q/N155Q/N168Q | 418 |
| N84Q/N155Q/N168Q/N207Q | 419 |
| N84Q/N119Q/N155Q/N207Q | 420 |
| N52Q/N84Q/N119Q/N207Q | 421 |
| N52Q/N84Q/N119Q/N155Q | 422 |
| N52Q/N84Q/N119Q/N155Q/N207Q | 423 |
| N84Q/N119Q/N155Q/N168Q/N207Q | 424 |

B. Binding to Cell-Expressed Counter Structures

The additional variants were formatted as Fc-fusion proteins as described in Example 4. The variant Fc-fusion molecules were assessed in binding studies to assess specificity and affinity of ICOSL domain variant immunomodulatory proteins for cognate binding partners. Expi293 cells transfected with cognate binding partners, human CD28, ICOS and CTLA4, were used in binding studies as described in Example 6. MFI was determined for each transfectant and compared to the corresponding unmodified (parental) ECD-Fc.

Results for the binding for exemplary variant ICOSL ECD-Fc fusion molecules are shown in Tables 28A-C. As shown in Table 28A-C, ICOSL IgSF (e.g. ECD) domain variants generated with the various combinations of specific mutations exhibited increased binding for at least one, and in some cases more than one, cognate counter structure ligand.

C. Bioactivity Characterization with Anti-CD3 Coimmobilization Assay

The costimulatory bioactivity of generated variant Fc-fusion molecules was also assessed in anti-CD3 coimmobilization assays as described in Example 6. Table 28A-C depicts the ratio of IFN-gamma produced by each variant ECD-Fc compared to the corresponding unmodified (wild-type) ICOSL ECD-Fc in the assay. Mutations designated with an "X" indicate a Q or the wildtype residue corresponding to the indicated position of SEQ ID NO. 32 at the indicated position. As shown, variant Fc-fusion molecules generated exhibited improved activities to increase immunological activity.

TABLE 28A

Molecule sequences, binding data, and costimulatory bioactivity data of variant ICOSL ECD-Fc molecules containing select mutations

| ICOSL Mutations | SEQ ID NO (ECD) | Binding ICOS MFI (parental ratio) | Binding CD28 MFI (parental ratio) | Binding CTLA-4 MFI (parental ratio) | Coimmobilization with anti-CD3 IFN-gamma pg/mL (parental ratio) |
|---|---|---|---|---|---|
| N52H, N57Y, Q100R, F172S, C198R | 436 | 118145 (1.33) | 59651 (29.60) | 178790 (41.12) | 5059 (37.90) |
| N52H, N57Y, Q100R, H115R, F172S, C198R | 437 | 125341 (1.41) | 51604 (25.60) | 211000 (48.53) | 8218 (61.57) |
| N52Y, N57Y, Q100P, F172S | 451 | 121280 (1.37) | 63663 (31.59) | 174224 (40.07) | 8123 (60.86) |
| E16V, N52H, N57Y, Q100R, V110D, H115R, Y152C, K156M, F172S, C198R | 453 | 107819 (1.22) | 68883 (34.18) | 170080 (39.12) | 8936 (66.95) |
| N52S, H115R, F120S, I143V, C198R | 459 | 116235 (1.31) | 25582 (12.69) | 22483 (5.17) | 125 (0.93) |
| N52H, N57Y, Q100P, C198R | 461 | 107164 (1.21) | 56103 (27.84) | 172319 (39.63) | 1258 (9.43) |
| N52H, N57Y, Q100P, H115R, F172S, C198R | 462 | 120864 (1.36) | 54586 (27.08) | 176637 (40.63) | 5507 (41.26) |
| N52H, N57Y, Q100P, F172S, C198R | 463 | 117954 (1.33) | 59376 (29.46) | 151265 (34.79) | 3884 (29.10) |
| N52H, N57Y, Q100P, H115R | 464 | 126221 (1.42) | 53321 (26.46) | 178812 (41.13) | 4154 (31.13) |
| N52H, N57Y, Q100P, H115R, C198R | 465 | 137004 (1.55) | 55454 (27.51) | 148417 (34.14) | 5069 (37.98) |

TABLE 28A-continued

Molecule sequences, binding data, and costimulatory bioactivity data of variant ICOSL ECD-Fc molecules containing select mutations

| ICOSL Mutations | SEQ ID NO (ECD) | Binding | | | Coimmobilization with anti-CD3 |
|---|---|---|---|---|---|
| | | ICOS MFI (parental ratio) | CD28 MFI (parental ratio) | CTLA-4 MFI (parental ratio) | IFN-gamma pg/mL (parental ratio) |
| N52H, Q100R, C198R | 466 | 111428 (1.26) | 58608 (29.08) | 116111 (26.71) | 3729 (27.94) |
| N52H, Q100R, H115R, F172S | 467 | 105532 (1.19) | 58287 (28.92) | 106295 (24.45) | 5294 (39.67) |
| N52H, Q100R, H115X, F172S, C198R | 468 | 106555 (1.20) | 73397 (36.42) | 171815 (39.52) | 6961 (52.16) |
| N52H, Q100R, H115R, F172S, C198R | 469 | 114223 (1.29) | 66686 (33.09) | 157154 (36.15) | 7592 (56.88) |
| N52H, N57Y, Q100R, F172S, C198R | 470 | 99350 (1.12) | 61292 (30.41) | 182288 (41.93) | 9167 (68.68) |
| N52H, N57Y, Q100R, H115R, F172S, C198R | 437 | 114057 (1.29) | 52011 (25.81) | 146471 (33.69) | 6545 (49.04) |
| N52H, N57Y, Q100R, H115R, F172S | 447 | 136143 (1.54) | 66516 (33.00) | 177376 (40.80) | 8527 (63.89) |
| N52H, N57Y, Q100R, H115R, F172S, C198R | 437 | 132970 (1.50) | 59633 (29.59) | 133247 (30.65) | 5999 (44.95) |
| Q100R | 427 | 62064 (8.31) | 16740 (8.31) | 29654 (8.31) | 35 (0.26) |
| Q100R ΔAAA | 427 | 1594 (8.20) | 16535 (8.20) | 33457 (8.20) | 87 (0.65) |
| F138L, L203P | 428 | 53804 (0.75) | 1510 (0.75) | 2151 (0.75) | 35 (0.26) |
| F138L, L203P ΔAAA | 428 | 53044 (0.93) | 1882 (0.93) | 1623 (0.93) | 35 (0.26) |
| N52Y, F138L, L203P | 429 | 99761 (23.50) | 47369 (23.50) | 67300 (23.50) | 1489 (11.16) |
| N52Y, F138L, L203P ΔAAA | 429 | 59576 (26.23) | 52865 (26.23) | 66553 (26.23) | 997 (7.47) |
| N57Y, Q100R, C198R | 430 | 58706 (28.65) | 57739 (28.65) | 99426 (28.65) | 9962 (74.64) |
| N57Y, Q100R, C198R ΔAAA | 430 | 98514 (28.63) | 57694 (28.63) | 131458 (28.63) | 6763 (50.67) |
| N57Y, F138L, L203P | 431 | 109472 (20.98) | 42276 (20.98) | 64477 (20.98) | 4979 (37.30) |
| N57Y, F138L, L203P ΔAAA | 431 | 97777 (22.29) | 44924 (22.29) | 64742 (22.29) | 6507 (48.75) |
| N52H | 110 | 91598 (28.91) | 58264 (28.91) | 103025 (28.91) | 3393 (25.42) |
| N57Y | 121 | 109031 (21.71) | 43754 (21.71) | 50683 (21.71) | 4881 (36.57) |
| N57Y, Q100P | 122 | 72480 (29.85) | 60161 (29.85) | 109522 (29.85) | 2797 (20.95) |
| Q100R, F138L | 432 | 65974 (2.23) | 4485 (2.23) | 8136 (2.23) | 685 (5.13) |
| L203P | 433 | 61554 (0.76) | 1533 (0.76) | 2031 (0.76) | 2434 (18.24) |
| Wildtype ICOSL ECD | 32 | 88625 (1.00) | 2015 (1.00) | 4348 (1.00) | 133 (1.00) |

TABLE 28B

Molecule sequences, binding data, and costimulatory bioactivity data of variant ICOSL ECD-Fc molecules containing select mutations

| ICOSL Mutations | SEQ ID NO (ECD) | Binding | | | Coimmobilization with anti-CD3 |
|---|---|---|---|---|---|
| | | ICOS MFI (parental ratio) | CD28 MFI (parental ratio) | CTLA-4 MFI (parental ratio) | IFN-gamma pg/mL (parental ratio) |
| N52H, N57Y, Q100R, H115R | 445 | 165027 (1.97) | 51666 (9.89) | 287581 (60.27) | 5858 (20.36) |
| N52H, N57Y, Q100R, F172S | 448 | 184449 (2.20) | 51394 (9.84) | 182109 (38.16) | 3449 (11.99) |

TABLE 28B-continued

Molecule sequences, binding data, and costimulatory bioactivity data of variant ICOSL ECD-Fc molecules containing select mutations

| ICOSL Mutations | SEQ ID NO (ECD) | Binding | | | Coimmobilization with anti-CD3 |
|---|---|---|---|---|---|
| | | ICOS MFI (parental ratio) | CD28 MFI (parental ratio) | CTLA-4 MFI (parental ratio) | IFN-gamma pg/mL (parental ratio) |
| N52H, N57Y, Q100R, H115R, F172S, I224V | 446 | 165120 (1.97) | 46636 (8.93) | 274026 (57.43) | 2053 (7.13) |
| N52H, N57Y, Q100R, H115R, F172S | 447 | 164750 (1.97) | 40046 (7.67) | 259351 (54.35) | 3722 (12.93) |
| N52H, N57Y, Q100R, H115R, C198R | 435 | 186017 (2.22) | 39073 (7.48) | 200505 (42.02) | 3909 (13.58) |
| N52H, N57Y, Q100R, F172S, C198R | 436 | 181118 (2.16) | 38233 (7.32) | 210709 (44.16) | 1199 (4.17) |
| N52H, N57Y, Q100R, H115R, F172S, C198R | 437 | 155392 (1.85) | 28828 (5.52) | 169736 (35.57) | 3449 (11.99) |
| N52H, N57Y, Q100R, H115R, I143V, F172S, C198R | 438 | 139977 (1.67) | 31459 (6.02) | 179089 (37.53) | 1620 (5.63) |
| N52H, N57Y, Q100R, L102R, H115R, F172S, C198R | 439 | 146799 (1.75) | 29636 (5.68) | 200000 (41.91) | 2712 (9.43) |
| N52H, N57Y, Q100R, H115R, F172S, N194D | 441 | 150863 (1.80) | 31304 (5.99) | 167783 (35.16) | 15607 (54.24) |
| N52H, N57Y, H115R, F172S, C198R | 442 | 126909 (1.51) | 35803 (6.86) | 152858 (32.03) | 5374 (18.67) |
| N52H, N57Y, Q100R, H115R, C198R | 443 | 131730 (1.57) | 37595 (7.20) | 139041 (29.14) | 9306 (32.34) |
| N52H, N57Y, H115R | 444 | 162632 (1.94) | 49847 (9.55) | 266878 (55.93) | 2918 (10.14) |
| N52H, Q100R, H115R, I143T F172S | 449 | 132873 (1.59) | 52058 (9.97) | 186366 (39.06) | 3086 (10.72) |
| N52H, N57Y, Q100P, H115R, F172S | 450 | 148160 (1.77) | 46851 (8.97) | 246636 (51.69) | 4987 (17.33) |
| E16V, N52H, N57Y, Q100R, V110D, H115R, C198R | 452 | 154036 (1.84) | 48674 (9.32) | 212905 (44.62) | 5095 (17.71) |
| N52S, E90A, H115R | 454 | 142963 (1.71) | 3597 (0.69) | 3772 (0.79) | 2241 (7.79) |
| N30D, K42E, N52S, H115R, C198R R221I | 456 | 124095 (1.48) | 8066 (1.54) | 7751 (1.62) | 417 (1.45) |
| N30D, K42E, N52S, H115R, C198R | 457 | 161734 (1.93) | 2791 (0.53) | 2919 (0.61) | 841 (2.92) |
| N30D, K42E, N52S, H115R, F172S, N194D | 458 | 117880 (1.41) | 4395 (0.84) | 4941 (1.04) | 2904 (10.09) |
| N30D, K42E, N52S, H115R, | 455 | 114107 (1.36) | 2935 (0.56) | 2748 (0.58) | 549 (1.91) |
| N52S, E90A, H115R, | 454 | 120450 (1.44) | 12768 (2.45) | 23282 (4.88) | 2890 (10.04) |
| N30D, K42E, N52S, H115R | 455 | 115273 (1.38) | 11964 (2.29) | 22779 (4.77) | 2241 (7.79) |
| N52S, H15R, F172S, C198R | 460 | 95537 (1.14) | 7614 (1.46) | 21701 (4.55) | 1458 (5.07) |
| Wildtype | 32 | 83813 (1.00) | 5222 (1.00) | 4772 (1.00) | 288 (1.00) |

TABLE 28C

Molecule sequences, binding data, and costimulatory bioactivity data of variant ICOSL ECD-Fc molecules containing glycosylation mutations

| ICOSL Mutation(s) | SSEQ ID NO (ECD) | Binding | | | Coimmobilization with anti-CD3 |
|---|---|---|---|---|---|
| | | ICOS MFI (parental ratio) | CD28 MFI (parental ratio) | CTLA-4 MFI (parental ratio) | IFN-gamma pg/mL (parental ratio) |
| N84Q | 387 | 34426 (0.94) | 1755 (1.16) | 5757 (1.51) | 100 (2.03) |
| N119Q | 388 | 30806 (0.84) | 4102 (2.70) | 19836 (5.21) | 81 (1.66) |
| N168Q | 389 | 27041 (0.74) | 1410 (0.93) | 18641 (4.90) | 67 (1.36) |

TABLE 28C-continued

Molecule sequences, binding data, and costimulatory bioactivity data of variant ICOSL ECD-Fc molecules containing glycosylation mutations

| ICOSL Mutation(s) | SSEQ ID NO (ECD) | Binding | | | Coimmobilization with anti-CD3 |
|---|---|---|---|---|---|
| | | ICOS MFI (parental ratio) | CD28 MFI (parental ratio) | CTLA-4 MFI (parental ratio) | IFN-gamma pg/mL (parental ratio) |
| N207Q | 390 | 36516 (1.00) | 11923 (7.86) | 25701 (6.76) | 206 (4.20) |
| N52Q, N207X | 391 | 30216 (0.83) | 12086 (7.97) | 27952 (7.35) | 77 (1.56) |
| N168X, N207X | 392 | 37191 (1.02) | 5787 (3.81) | 12280 (3.23) | 104 (2.12) |
| N52Q, N168Q | 393 | 32576 (0.89) | 12638 (8.33) | 27167 (7.14) | 101 (2.06) |
| N84Q, N207Q | 394 | 37176 (1.02) | 5292 (3.49) | 3153 (0.83) | 31 (0.63) |
| N155Q, N207Q | 395 | 34884 (0.95) | 1489 (0.98) | 987 (0.26) | 73 (1.48) |
| N119Q, N168Q | 396 | 29099 (0.80) | 2534 (1.67) | 11289 (2.97) | 51 (1.05) |
| N119Q, N207Q | 397 | 32603 (0.89) | 1861 (1.23) | 6795 (1.79) | 153 (3.12) |
| N119Q, N155X | 398 | 38516 (1.05) | 15318 (10.10) | 27498 (7.23) | 173 (3.52) |
| N52Q, N84Q | 399 | 33988 (0.93) | 1675 (1.10) | 3525 (0.93) | 39 (0.80) |
| N52Q, N119Q | 400 | 35729 (0.98) | 11040 (7.28) | 26139 (6.87) | 51 (1.03) |
| N84Q, NH9Q | 401 | 34777 (0.95) | 1493 (0.98) | 2877 (0.76) | 39 (0.80) |
| N52Q, N84Q, N168Q | 402 | 27021 (0.74) | 1584 (1.04) | 958 (0.25) | 38 (0.78) |
| N52Q, N84Q, N207Q | 403 | 39942 (1.09) | 13396 (8.83) | 26360 (6.93) | 37 (0.76) |
| N84Q, N155Q, N168Q | 404 | 27812 (0.76) | 357 (0.24) | 466 (0.12) | 30 (0.61) |
| N84Q, N168Q, N207Q | 405 | 30659 (0.84) | 737 (0.49) | 861 (0.23) | 25 (0.52) |
| N84Q, N155H, N207Q | 406 | 13557 (0.37) | 685 (0.45) | 607 (0.16) | 29 (0.59) |
| N155Q, NI68Q, N207Q | 407 | 13999 (0.38) | 277 (0.18) | 317 (0.08) | 40 (0.82) |
| N119Q, N155Q, N168Q | 408 | 36896 (1.01) | 4094 (2.70) | 2179 (0.57) | 50 (1.02) |
| N119Q, N168Q, N207Q | 409 | 29543 (0.81) | 921 (0.61) | 3744 (0.98) | 72 (1.47) |
| N84Q, N119Q, N207Q | 410 | 21357 (0.58) | 569 (0.38) | 640 (0.17) | 59 (1.20) |
| N119Q, N155H, N207Q | 411 | 37310 (1.02) | 614 (0.40) | 931 (0.24) | 86 (1.75) |
| N84Q, N119Q, N155Q | 412 | 2675 (0.07) | 262 (0.17) | 291 (0.08) | 34 (0.70) |
| N52Q, N119Q, N155Q | 413 | 27853 (0.76) | 552 (0.36) | 772 (0.20) | 42 (0.87) |
| N52H, N84Q, N119Q | 414 | 40700 (1.11) | 4580 (3.02) | 4601 (1.21) | 39 (0.80) |
| N52H, N84Q, N168X, N207X | 415 | 8796 (0.24) | 587 (0.39) | 481 (0.13) | 32 (0.66) |
| N52Q, N84Q, N155X, N168X | 416 | 43521 (1.19) | 6605 (4.35) | 4811 (1.26) | 32 (0.66) |
| N52Q, N84Q, N119Q, N168Q | 417 | 39342 (1.07) | 4519 (2.98) | 3300 (0.87) | 37 (0.76) |
| N52Q, N84Q, N119Q, N207Q | 421 | 7011 (0.19) | 602 (0.40) | 433 (0.11) | 37 (0.75) |
| Wildtype ICOSL ECD | 32 | 36602 (1.00) | 1517 (1.00) | 3804 (1.00) | 49 (1.00) |

Example 21

Generation and Assessment of Fusion Molecules with HER2-Targeting Antibody

This Example describes the generation and assessment of variant ICOSL ECD-Fc fusion molecules conjugated with a tumor targeting agent to form a conjugate ("vIgD conjugate").

The V-domain only of the ICOSL vIgD (N52H/N57Y/Q100P; set forth in SEQ ID NO: 201) was fused to the amino and carboxyl termini of the light chain (FIG. 10A) and heavy chain (FIG. 10B) of a HER2 targeting antibody with intervening GGGSGGGS linkers. Exemplary configurations of vIgD conjugates are shown in FIG. 10C.

Figure 11A:
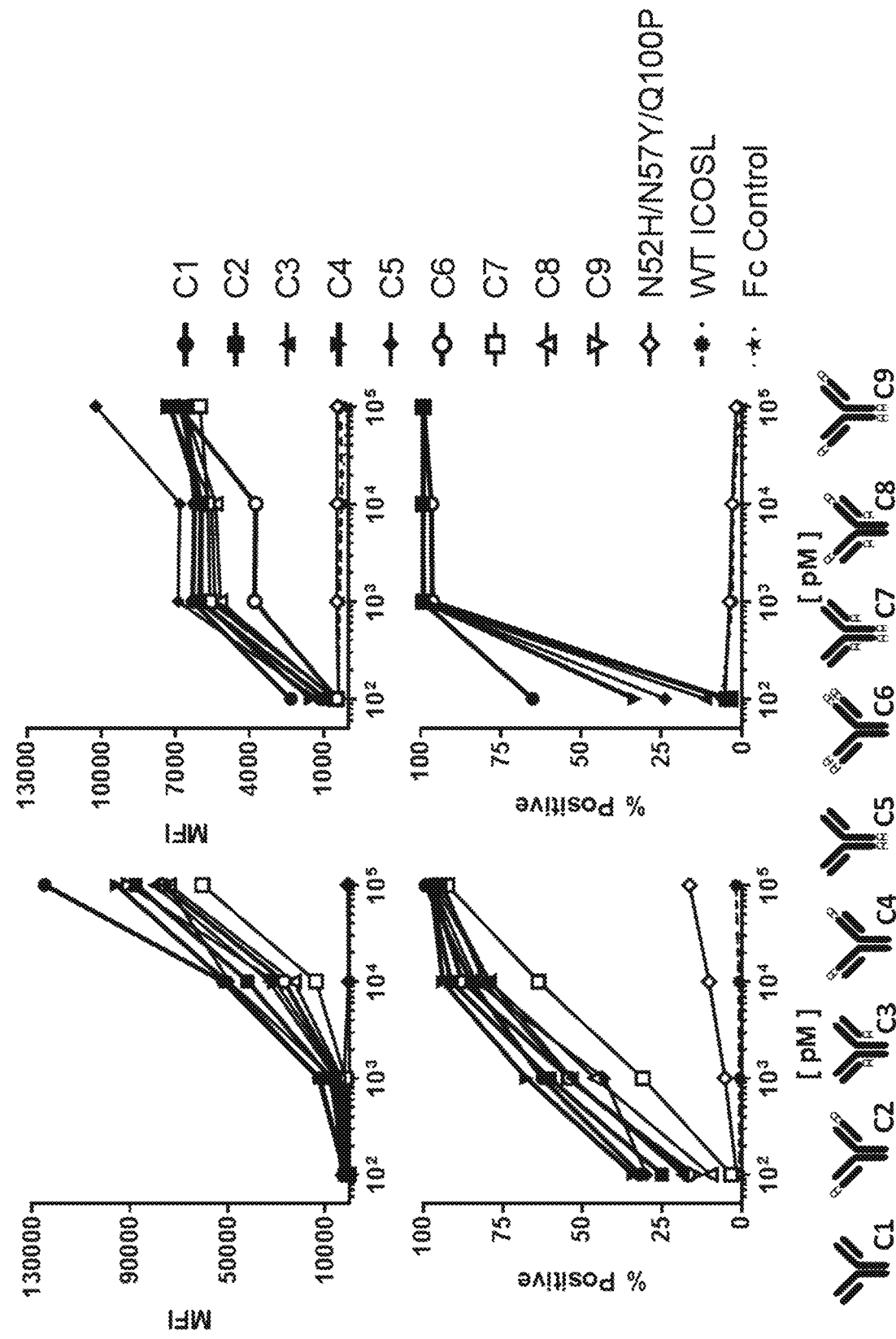

To assess HER2 binding, HER2 DNA or mock Expi293 transfectants were stained with titrated amounts of a HER2 targeting antibody containing the variant ICOSL conjugate (vIgD N52H/N57Y/Q100P conjugate) at a concentration of 100 pM to 100 nM. Control proteins, including wildtype ICOSL ECD-Fc fusion, wildtype PD-L2 IgV-Fc fusion, and variant ICOSL ECD-Fc fusion molecule with mutations at N52H/N57Y/Q100P, were also tested. Mean Fluorescence Intensity (MFI) or percent positive cells was determined for each transfectant as described in Example 6. All IgSF conjugates generated as shown in FIGS. 11A-11B retained binding to HER2 compared to the endogenous level of HER2 expression observed in Expi293 cells. Similarly, vIgD conjugates also showed binding to cognate binding partners of ICOSL including CD28, CTLA-4, and ICOS.

Figure 12:
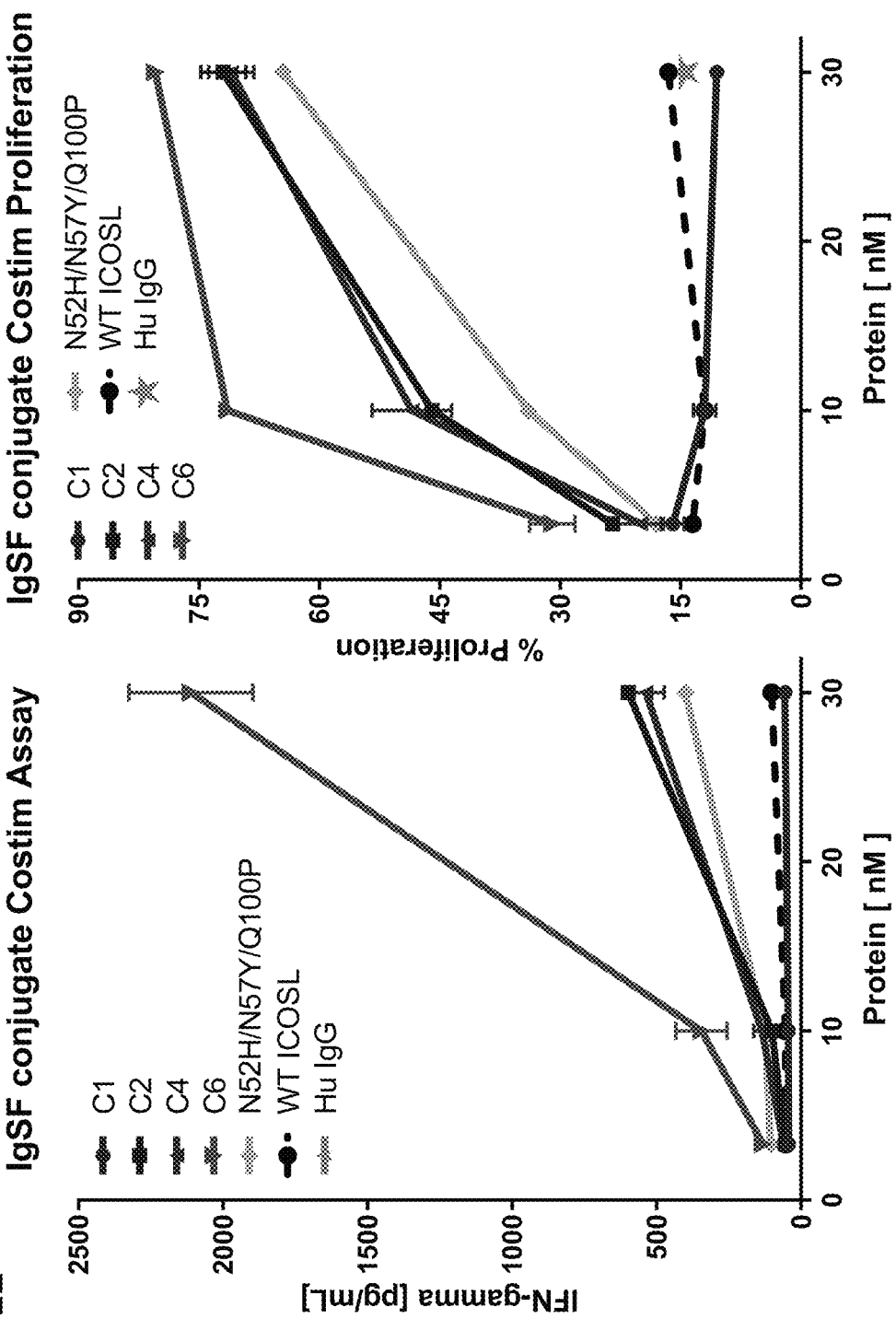
FIG. 12 demonstrates V-Mab costimulatory and proliferative capacity when coimmobilized with anti-CD3. 10 nM anti-CD3 was wet coated to the wells of 96-well flat bottomed polystyrene tissue culture plates with 30 nM to 3 nM parental antibody, V-Mabs, or Fc controls. CFSE-labeled pan T-cells were added for 72 hours. IFN-gamma secretion was measured by ELISA and total T-cell proliferation was measured by flow cytometric analysis of CFSE-dilution. IFN-gamma secretion and proliferation of IgSF-domain (N52H/N57Y/Q100P) is greater than WT ICOSL. V-Mabs demonstrate increased cytokine and proliferative costimulatory capacity over the parental IgSF.

Protein bioactivity and proliferation of human primary T cell in vitro assays were also characterized as described in Example 6. vIgD conjugates were bound overnight to 96-well plates at 30-0.1 nM in the presence of 10 nM anti-CD3. The plates were washed and 100,000 CFSE-labeled pan T cells were added to the plates and incubated for 72 hours. IFN gamma levels in supernatant were assayed by ELISA. As shown in FIG. 12, vIgD conjugates with the indicated configurations showed greater IFN gamma secretion and proliferation compared to parental wild-type ICOSL ECD-Fc fusion molecule conjugate.

Example 22

Nanostring Transcriptional Signature of Primary Human T Cells

Figure 18:
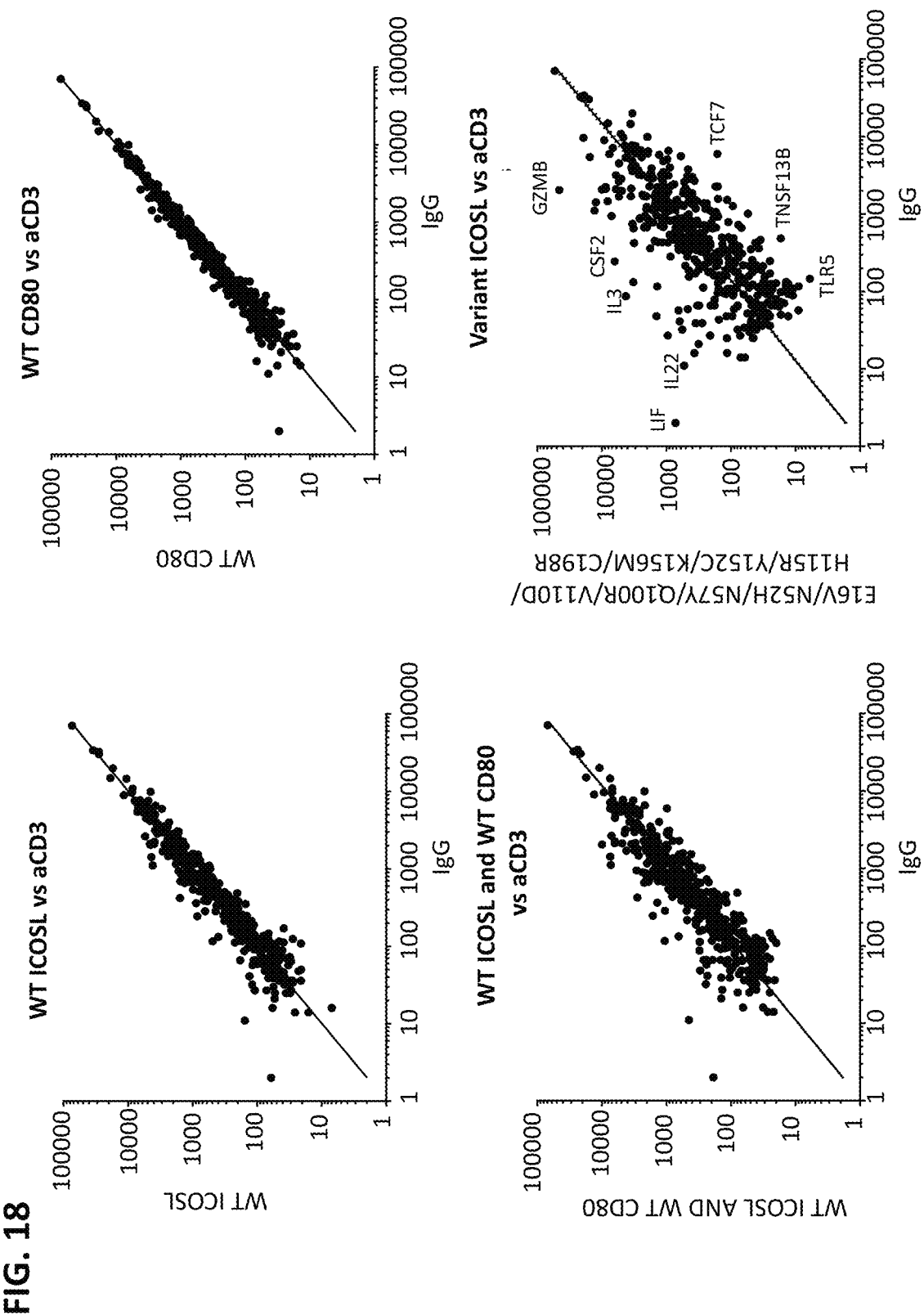
FIG. 18 depicts the Nanostring transcriptional signature of primary human T cells when incubated 10 nM anti-CD3 with 40 nM of an Fc-control protein, wild-type ICOSL-Fc, wild-type CD80-Fc, both of these proteins, or a variant ICOSL Fc-fusion proteins with mutations as indicated. Total RNA from samples was prepared from harvested cells and the RNA was transferred to Nanostring and a Cancer Immune chip was used to quantitate transcripts of 750 gene in each sample. Altered transcripts include those whose level is above or below the diagonal line, including the noted transcripts.
Figure 19:
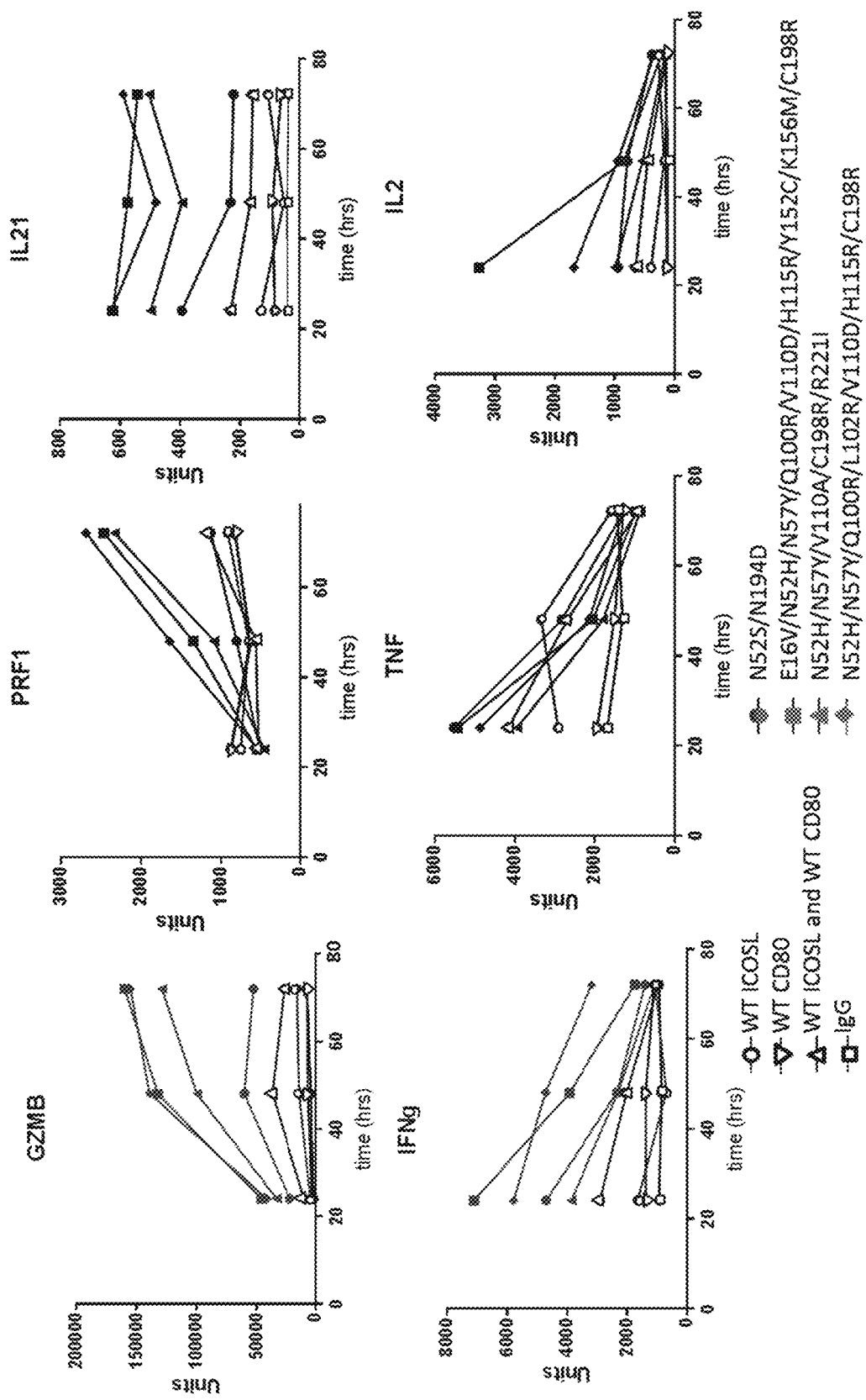
FIG. 19 depicts transcript levels of exemplary transcripts upon incubation as described in FIG. 18 for the indicated times in the presence of the various immunomodulatory proteins.

Tissue culture plates were coated with 10 nM anti-CD3 with 40 nM of an Fc-control protein, wild-type ICOSL-Fc, wild-type CD80-Fc, both of these proteins, or variant ICOSL Fc-fusion proteins with mutations as indicated. Purified human T cells were then plated on the protein coated plates and incubated at 37° C. Cultures from each treatment group described above were harvested at 24, 48 and 72 hours and total RNA was prepared from each cell sample. The RNA was transferred to Nanostring and a Cancer Immune chip was used to quantitate transcripts of 750 gene in each sample. Transcript values were normalized using Nanostring's proprietary software allowing comparison of transcript levels between treatment groups and over the various time points. As shown in FIG. 18 and FIG. 19, the variant ICOSL ECD-Fc polypeptides tested show altered inflammatory activity compared to wildtype CD80 ECD-Fc, wild-type ICOSL ECD-Fc, or a combination of both.

Example 23

Generation and Assessment of Fusion Molecules with HER2-Targeting Antibody

Figure 20B:
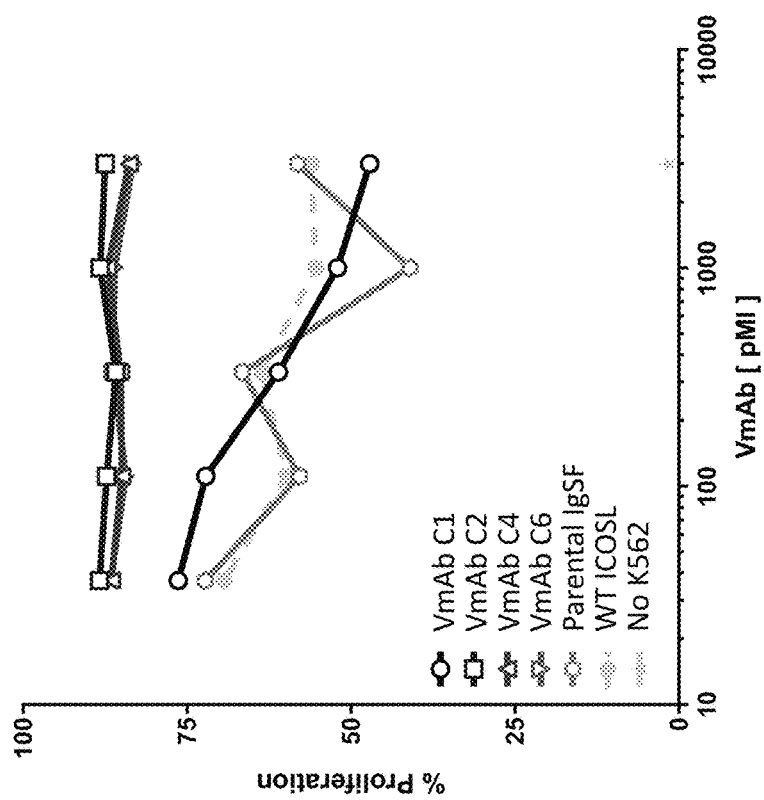
Figure 20B:
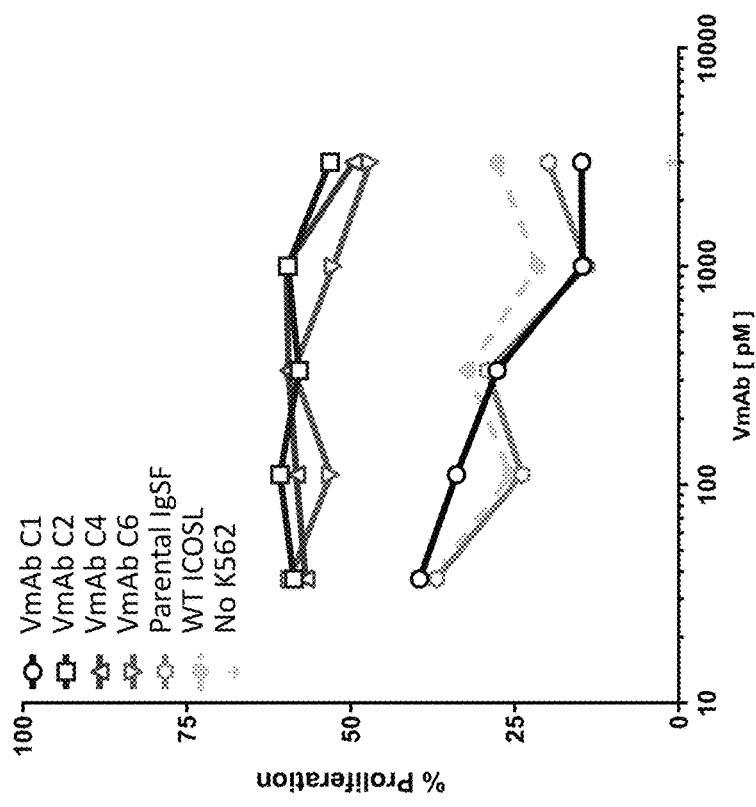

Proliferation of human T-cells co-cultured with VmAbs and HER2 expressing target cells was also characterized. CFSE-labeled pan T-cells were stimulated for 72 hours with K562-derived artificial target cells displaying cell surface anti-CD3 single chain Fv (OKT3) and HER2 in the presence of VmAbs or control proteins. Proliferation was measured by flow cytometric analysis of CFSE-dilution on $CD4^+$ or $CD8^+$ stained T-cells. Vmabs were assayed varying either target cell number or the concentration of the VmAb utilized. In the first assay, K562 target cells were titrated from 2500 to 78 cells/well and added to 100,000 T-cells for an effector:target (E:T) range of 40 to 1280:1. VmAbs, parental IgSF domain, or WT ICOSL were added at 1000 pM. In the second assay, K562 target cells were added at 625 cells/well to 100,000 T-cells for an effector:target ratio of 160:1. VmAbs or control proteins were titrated and added at 3000 to 37 pM. As shown in FIGS. 20A and 20B, both configurations of the assay demonstrate VmAbs containing the vIgD-conjugate provide superior proliferation compared to the parental antibody, parental IgSF domain, or WT ICOSL. Additionally, vIgD-conjugates mediated proliferation at low E:T ratios (1280:1) or at low protein concentrations (37 pM).

Example 24

Generation and Assessment of Engineered Cells Expressing a Transmembrane Immunomodulatory Protein and a T Cell Receptor This Example describes the expression of various variant ICOSL IgSF domain-containing transmembrane immunomodulatory proteins (TIPs) with an exemplary recombinant E6-specific T cell receptor (TCR) in human T cells and assessment of T cell proliferation.

Human HLA-A2+ T cells were activated on Day 0 with anti-CD3/anti-CD28 activation beads (ThermoFisher Scientific, USA) and transduced, on day 1, with a TCR specific to HPV E6 (described in WO 2015/009606) and various transmembrane immunomodulatory proteins (TIPs) containing a variant ICOSL IgSF domain. The exemplary ICOSL-TIPs had an affinity-modified IgSF domain containing amino acid mutations corresponding to either E16V/N52H/N57Y/Q100R/V110D/H115R/Y152C/K156M/C198R or N52H/N57Y/Q100R with reference to positions in the ICOSL extracellular domain set forth in SEQ ID NO: 32. The ICOSL TIPs also included a transmembrane and cytoplasmic domain corresponding to residues 257-302 of SEQ ID NO: 5. For comparison, T cells also were co-transduced with the HPV E6 TCR and either a WT CD80-TIP (set forth as amino acids 35-288 of SEQ ID NO: 1 and encoded by the sequence of nucleotides set forth in SEQ ID NO:251) or a WT ICOSL-TIP (set forth as amino acids 19-302 of SEQ ID NO:5 and encoded by the sequence of nucleotides set forth in SEQ ID NO:252). For transduction, cells were transduced with a viral vector construct in which was inserted a polynucleotide encoding the TIP and the TCRα and TCRβ chain sequences, each separated from each other by a sequence encoding a P2A ribosome skip sequence (SEQ ID NO: 863), for co-expression of the TIP and the TCR containing the TCRα and TCRβ chain in the engineered cells. Specifically, the nucleic acid construct had the following structure: ICOSL-P2A1-TCRβ-P2A2-TCRα, in which the nucleotide sequence P2A1 and P2A2 each encoded the P2A set forth in SEQ ID NO: 863 but differed in the nucleotide sequence to avoid recombination between sequences.

As a control, T cells were mock transduced or transduced with the exemplary E6 TCR only.

Figure 21:
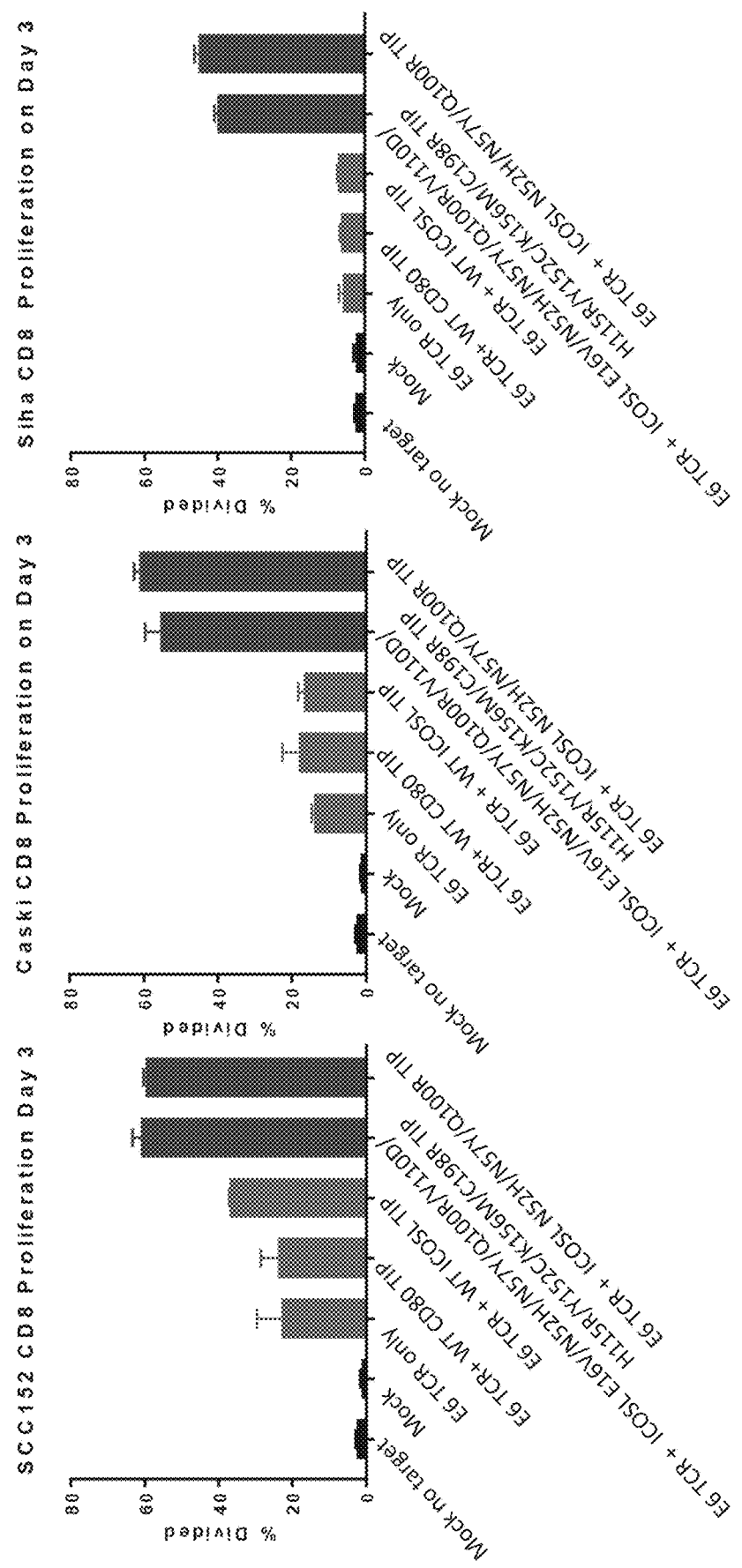
FIG. 21 depicts the proliferation studies for T cells transduced with various IgSF domain-containing transmembrane immunomodulatory proteins (TIPs) and an exemplary recombinant E6-specific TCRs in primary human T cells.

The T cell activation beads were removed on day 3 and cytokines IL-2, IL-7, and IL-15 were added to the culture. On day 6 after transduction, cell surface expression of the TIP and TCR was assessed by flow cytometry, with 35-65% of engineered cells double positive for the TCR and TIP. The TCR-expressing cells were expanded in the presence of HPV E6 peptide to result in a population of cells that were >90% double positive for the TCR/TIP as assessed at day 14. On day 14, the engineered cells were incubated with HPV-infected cells, either a squamous cell carcinoma cell line UPCI:SCC152 (ATCC® CRL-3240™; HPV+, HLA-A2+), epidermoid carcinoma CaSki cells (ATCC® No. CRL-1550™; HPV+, HLA-A2+), or squamous cell carcinoma SiHa cells (ATCC® HTB-35™; HPV+, HLA-A2−). Proliferation of the engineered cells was assessed on day 3 after initiation of co-culture with target cells. As shown in FIG. 21, increased proliferation of T cells engineered with E6 TCR was observed in the two HPV+ cell lines, but not significantly in the HPV− SiHa line. Engineered cells that co-expressed variant ICOSL TIPS had increased proliferation in response to the HLA-A2+HPV+ target SCC152 and Caski cell lines.

Example 25

Generation and Assessment of Fc-Fusion Immunomodulatory Proteins

Variant ICOSL IgSF (e.g. ECD) domain-containing molecules were formatted as Fc-fusion proteins substantially as described in Example 4, except using various linkers and Fc molecules. To generate immunomodulatory proteins that are Fc fusion proteins containing an ECD of ICOSL with at least one affinity-modified domain (e.g. variant ICOSL ECD-Fc), the encoding nucleic acid molecule was generated to encode a protein designed as follows: variant (mutant) ECD linked directly or indirectly via a linker to an inert human IgG1 Fc. Specifically, the generated immunomodulatory proteins either did not contain a linker (none) or contained a AAA or a G4S (SEQ ID NO: 636) linker. The inert human IgG1 Fc contained mutations, by EU numbering, as follows: C220S/R292C/N297G/V302C (SEQ ID NO: 476), C220S/E233P/L234V/L235A/G236del/S267K (SEQ ID NO: 478), C220S/L234A/L235E/G237A (SEQ ID NO: 477), or allotypes thereof. The replacement C220S was included because the resulting proteins do not include an antibody light chain that can form a covalent bond with a cysteine. The recombinant variant Fc fusion proteins were produced in 293 cells and purified with Protein A substantially as described in Example 5.

The variant ICOSL Fc-fusion immunomodulatory proteins were assessed in binding studies to assess binding for cognate binding partners. Expi293 cells transfected with cognate binding partners, human CD28, ICOS and CTLA4, were used as target cells in binding studies as described in Example 6. MFI of binding of variant ICOSL Fc fusion immunomodulatory proteins for target cell expressing each binding partner was determined and compared to the binding of the corresponding unmodified (wildtype) ICOSL ECD-Fc to the same target cells. Modulation of T cell activity by the variant ICOSL Fc-fusion immunomodulatory proteins was also determined using a mixed lymphocyte reaction (MLR) substantially as described in Example 6.

Results for the binding of exemplary variant ICOSL ECD-Fc fusion immunomodulatory proteins containing various linkers and Fc regions are shown in Table 29. The Table indicates amino acid substitutions in the ECD of the variant ICOSL as designated by amino acid position number corresponding to amino acid positions in the respective reference (e.g., unmodified) ICOSL extracellular domain (ECD) sequence set forth in SEQ ID NO:32. Column 1 also sets forth the SEQ ID NO identifier for each variant ECD domain contained in the variant ICOSL Fc fusion. Column 2 indicates the linker used in the Fc fusion protein and the SEQ ID NO identifier for the linker. Column 3 sets forth the mutations in the Fc by EU numbering and the SEQ ID NO identifier for the Fc contained in the variant ICOSL Fc fusion protein.

As shown in Table 29, similar results were observed for binding to cognate binding partners among the tested variant ICOSL Fc fusion proteins. These results indicate that the format of the Fc fusion with different Fc molecules or different linkers did not impact the binding of the ICOSL IgSF domain variants for their cognate binding partner. In addition, all Fc fusion formats, when provided as bivalent Fc molecules in solution in an MLR reaction, exhibited an antagonist activity to decrease T cell activation compared to the reference (e.g. unmodified or wildtype) ECD-Fc molecule not containing the amino acid substitution. In some cases, no detectable IFN-gamma was measured in the supernatant consistent with complete blocking of interactions of costimulatory ligand cognate binding partners with their ligands to induce IFN-gamma secretion.

TABLE 29

Molecule sequences, binding data, and costimulatory bioactivity data of variant ICOSL ECD-Fc molecules

| ICOSL Mutation (s) (SEQ ID NO) | Linker (SEQ ID NO) | Fc Mutations (SEQ ID NO) | Binding | | | MLR IFN-gamma pg/mL (ΔWT) |
|---|---|---|---|---|---|---|
| | | | CD28 MFI (ΔWT) | CTLA-4 MFI (ΔWT) | ICOS MFI (ΔWT) | |
| N52H/N57Y/Q100R/F172S (291) | AAA | C220S/R292C/N297G/V302C (476) | 67870 (13.0) | 213333 (22.7) | 120042 (1.5) | 3 (0.02) |
| N52H/N57Y/Q100R/F172S (291) | AAA | C220S/E233P/L234V/L235A/G236del/S267K (478) | 57272 (10.9) | 192595 (20.5) | 103983 (1.3) | 0 (0.00) |
| N52H/N57Y/Q100R/F172S (291) | AAA | C220S/L234A/L235E/G237A (477) | 65506 (12.5) | 193704 (20.6) | 105432 (1.3) | 0 (0.00) |
| N52H/N57Y/Q100R/F172S (291) | G4S (636) | C220S/E233P/L234V/L235A/G236del/S267K (478) | | | | |

TABLE 29-continued

Molecule sequences, binding data, and costimulatory bioactivity data of variant ICOSL ECD-Fc molecules

| ICOSL Mutation (s) (SEQ ID NO) | Linker (SEQ ID NO) | Fc Mutations (SEQ ID NO) | Binding | | | MLR IFN-gamma pg/mL (ΔWT) |
|---|---|---|---|---|---|---|
| | | | CD28 MFI (ΔWT) | CTLA-4 MFI (ΔWT) | ICOS MFI (ΔWT) | |
| N52H/N57Y/Q100R/F172S (291) | G4S (636) | C220S/L234A/L235E/G237A (477) | 67596 (12.9) | 212875 (22.7) | 106576 (1.4) | 0 (0.00) |
| N52H/N57Y/Q100R/F172S (291) | none | C220S/E233P/L234V/L235A/G236del/S267K (478) | — | — | — | — |
| N52H/N57Y/Q100R/F172S (291) | none | C220S/L234A/L235E/G237A (477) | 59987 (11.5) | 210061 (22.4) | 106405 (1.4) | 0 (0.00) |
| N52H/Q100R (285) | AAA | C220S/R292C/N297G/V302C (476) | 57419 (11.0) | 190012 (20.2) | 86522 (1.1) | 30 (0.26) |
| N52H/Q100R (285) | AAA | C220S/E233P/L234V/L235A/G236del/S267K (478) | | | | |
| N52H/Q100R (285) | AAA | C220S/L234A/L235E/G237A (477) | 58772 (11.2) | 211494 (22.5) | 88969 (1.1) | 25 (0.22) |
| N52H/Q100R (285) | G4S (636) | C220S/E233P/L234V/L235A/G236del/S267K (478) | 62331 (11.9) | 207285 (22.1) | 110512 (1.4) | 31 (0.28) |
| N52H/Q100R (285) | G4S (636) | C220S/L234A/L235E/G237A (477) | 70142 (13.4) | 187699 (20.0) | 125505 (1.6) | 49 (0.44) |
| N52H/Q100R (285) | none | C220S/E233P/L234V/L235A/G236del/S267K (478) | 58726 (11.2) | 206110 (21.9) | 110721 (1.4) | 54 (0.48) |
| N52H/Q100R (285) | none | C220S/L234A/L235E/G237A (477) | 62746 (12.0) | 198281 (21.1) | 96948 (1.2) | 16 (0.14) |
| N52H/N57Y/Q100P (113) | AAA | C220S/R292C/N297G/V302C (476) | 79792 (15.3) | 193633 (20.6) | 91384 (1.2) | 1 (0.01) |
| N52H/N57Y/Q100P (113) | AAA | C220S/E233P/L234V/L235A/G236del/S267K (478) | 69603 (13.3) | 314593 (33.5) | 103387 (1.3) | 0 (0.00) |
| N52H/N57Y/Q100P (113) | AAA | C220S/L234A/L235E/G237A (477) | 68729 (13.1) | 171223 (18.2) | 97068 (1.2) | 0 (0.00) |
| N52H/N57Y/Q100P (113) | G4S (636) | C220S/E233P/L234V/L235A/G236del/S267K (478) | 67753 (13.0) | 188192 (20.0) | 93424 (1.2) | 1 (0.01) |
| N52H/N57Y/Q100P (113) | G4S (636) | C220S/L234A/L235E/G237A (477) | 69887 (13.4) | 160705 (17.1) | 104124 (1.3) | 0 (0.00) |
| N52H/N57Y/Q100P (113) | None | C220S/E233P/L234V/L235A/G236del/S267K (478) | 68979 (13.2) | 184726 (19.7) | 98512 (1.3) | 0 (0.00) |
| N52H/N57Y/Q100P (113) | none | C220S/L234A/L235E/G237A (477) | 67863 (13.0) | 154563 (16.5) | 97714 (1.2) | 0 (0.00) |
| WT (32) | AAA | C220S/R292C/N297G/V302C (476) | 5232 (1.0) | 9394 (1.0) | 78795 (1.0) | 113 (1.00) |

Example 26

Expression of Variant ICOSL Molecules in CHO Cells

As an alternative to expressing variant ICOSL Fc fusion proteins in Expi293 cells as described in Example 5, suspension Chinese hamster ovary cells (ExpiCHO-S) cells were used to produce various ICOSL molecules. A DNA construct encoding the exemplary variant ICOSL IgSF (e.g. ECD) Fc-fusion proteins containing the variant (mutant) ECD N52H/N57Y/Q100R/F172S (SEQ ID NO:291) linked to an inert Fc containing mutations C220S/L234A/L235E/G237A by EU numbering set forth in SEQ ID NO: 477 or an allotype thereof set forth in SEQ ID NO: 637, with a GSGGGGS linker (SEQ ID NO: 635) was used to transfect cells.

ExpiCHO-S cells, and reagents for transfection using the ExpiCHO™ Expression System, were purchased from ThermoFisher Scientific (Cat #A29133). The cells were thawed and expanded per manufacture's recommended protocol. After at least 2 passages, the cells were split 24 hours pre-transfection and allowed to expand to high density. Cells were then diluted to the number of cells for transfection, DNA complex was formed with the ExpiFectamine™ CHO reagent and added to the cells. One day post DNA complex addition the ExpiCHO™ feed and ExpiFectamine™ CHO Enhancer were added to the culture, which was then placed in a 32 degree C. incubator. The cell viability and cell mass were monitored and the culture was harvested when the viability fell below 80%. The culture was then centrifuged at low speed to remove the cell pellet, and the cleared supernatant was 0.2 um sterile filtered. Protein was purified as described in Example 5.

A. Protein Analysis

The purified variant ICOSL Fc fusion protein was run on SDS-PAGE and analyzed by protein staining. Multiple bands were observed in cells produced from CHO cells but not from 293 cells, which is consistent with an observation that proteolysis clipping of the ICOSL was occurring when expressed in CHO cells. Table 30A depicts the molecular weight of intact, single-clipped, and double clipped proteins calculated based on amino acid sequences and potential carbohydrates as observed by SDS-PAGE. Proteolysis of the ICOSL Fc-fusion proteins expressed in ExpiCHO-S derived cells was observed, as indicated by the presence of both reduced/non-reduced clipped species with lower molecular weight (single and double clipping). Based on the size of the observed bands and Mass Spectrometry analysis, these results are consistent with a potential cleavage site in ICOSL ECD corresponding to the sequence LQQN/LT ("/" indicates potential cleavage site), thereby resulting in cleavage before the stalk region of the ECD and removal of the Fc portion of the sequence in one or both chains of the Fc fusion protein. The observed protease cleavage may result in a heterogenous protein product when produced in CHO cells. Also, for formats expressed as transmembrane immunomodulatory proteins, protease cleavage, occurring in certain cells, could lead to release of soluble protein from cells, thereby reducing cell surface-expressed forms of the variant protein on engineered cells.

TABLE 30A

Reduced/Non-Reduced Species Detected After Capture and Elution from Protein A Column Chromatography Using SDS-PAGE to Assay Proteolysis

| | Calculated MW | | Observed (Apparent) MW[1] | |
|---|---|---|---|---|
| | Non Reduced | Reduced | Non Reduced | Reduced |
| Intact | 105.6 kD aa ~29 kD carb | 52.8 kD aa ~14.5 kD carb | 150 kD | 80 kD |
| Single Clip | 135 kD total 78.8 kD aa ~16.5 kD carb | 67.3 kD total 52.8 kD aa ~14.5 kD carb | 100 kD | 80 kD 37 kD |
| | 95.3 kD total | 67.3 kD total 26 kD aa ~2 kd carb | | |
| Double Clip | 52.1 kD aa ~4 kD carb | 28 kD total 26 kD aa ~2 kd carb | 65 Kd | 37 kD |
| | 56.1 kdD total | 28 kd total | | |

[1]Estimated MW from SDS-PAGE relative to Protein MW Markers

Example 27

Generation of Proteolysis-Resistant Variants of ICOSL IgSF Domain-Containing Molecules To render variant ICOSL polypeptides resistant to proteolysis upon expression in cells, such as in CHO cells, various additional forms of variant ICOSL polypeptides were generated. The following additional modified reference sequences of the ICOSL ECD were generated: (1) various ECD truncations lacking all or a portion of the LQQN/LT protease cleavage site (designated Trunc #4, #5, #6, #7, or #8); (2) ICOSL variant reference sequences containing mutations at cleavage site N207 and/or L208 with reference to positions set forth in SEQ ID NO:32; or an ICOSL alone IgV reference sequence containing the IgV domain as the only IgSF domain of the molecule (set forth in SEQ ID NO: 545, corresponding to amino acids 1-122 of SEQ ID NO:32). In some cases, combinations of the above strategies were employed in a ICOSL ECD reference sequence. Table 30B below sets forth various generated reference sequences.

The exemplary mutations N52H/N57Y/Q100R/F172S, with reference to numbering set forth in SEQ ID NO: 32, were introduced into the various reference sequences. Because the reference ICOSL IgV set forth in SEQ ID NO: 545 does not contain a position corresponding to F172S, the variant ICOSL IgV did not contain the mutation F172S. The generated variant ICOSL polypeptides were formatted as an Fc fusion protein containing the generated reference ICOSL IgSF domain linked via a (G$_4$S)2 linker (SEQ ID NO:229) to an inert Fc containing mutations C220S/L234A/L235E/G237A/K447del by EU numbering set forth in SEQ ID NO: 633, or an allotype thereof set forth in SEQ ID NO:637.

TABLE 30B

Exemplary ICOSL IgSF-containing domain reference sequences

| Reference ICOSL Sequence | ...----------ECD--------<br>-------\|---------Stalk--<br>----------------------<br>------------- |
|---|---|
| Full ECD (32) | ...VNIGCCIENVLLQQNLTVGSQTGN<br>DIGERDKITENPVSTGEKNAAT |
| Truncation #2 (600) | ...VNIGCCIENVLLQQNL |
| Truncation #3 (601) | ...VNIGCCIENVLLQQNLTVGSQ |
| Truncation #4 (602) | ...VNIGCCIENVLLQQN |
| Truncation #5 (603) | ...VNIGCCIENVLLQQ |
| Truncation #6 (604) | ...VNIGCCIENVLL |
| Truncation #7 (605) | ...VNIGCCIEN |
| Truncation #8 with N207G/L208G (623) | ...VNIGCCIENVLLQQGGT |
| ECD with N207A (624) | ...VNIGCCIENVLLQQALTVGSQTGN<br>DIGERDKITENPVSTGEKNAAT |
| ECD with N207G/L208G (628) | ...VNIGCCIENVLLQQGGTVGSQTGN<br>DIGERDKITENPVSTGEKNAAT |
| IgV (545) | ...HVAANFSV |

A. Proteolysis Assessment

DNA constructs encoding the variant ICOSL Fc-fusion molecules described above were transfected into Chinese hamster ovary cells (ExpiCHO-S). The ICOSL Fc-fusion proteins were then purified from supernatants with Protein A by affinity chromatography as described in Example 5. Purified protein was analyzed by analytical SEC.

Figure 22A:
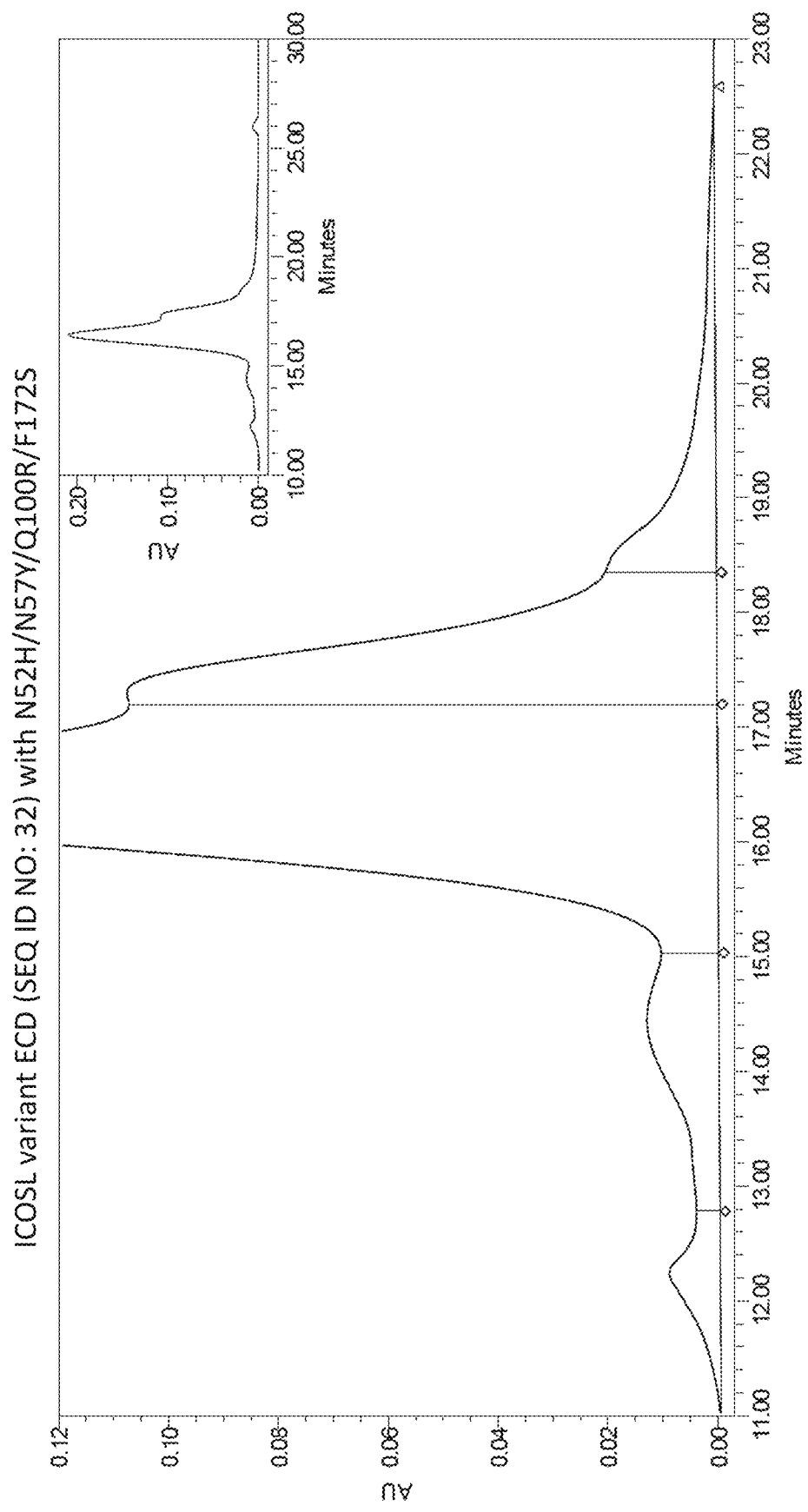
Figure 22B:
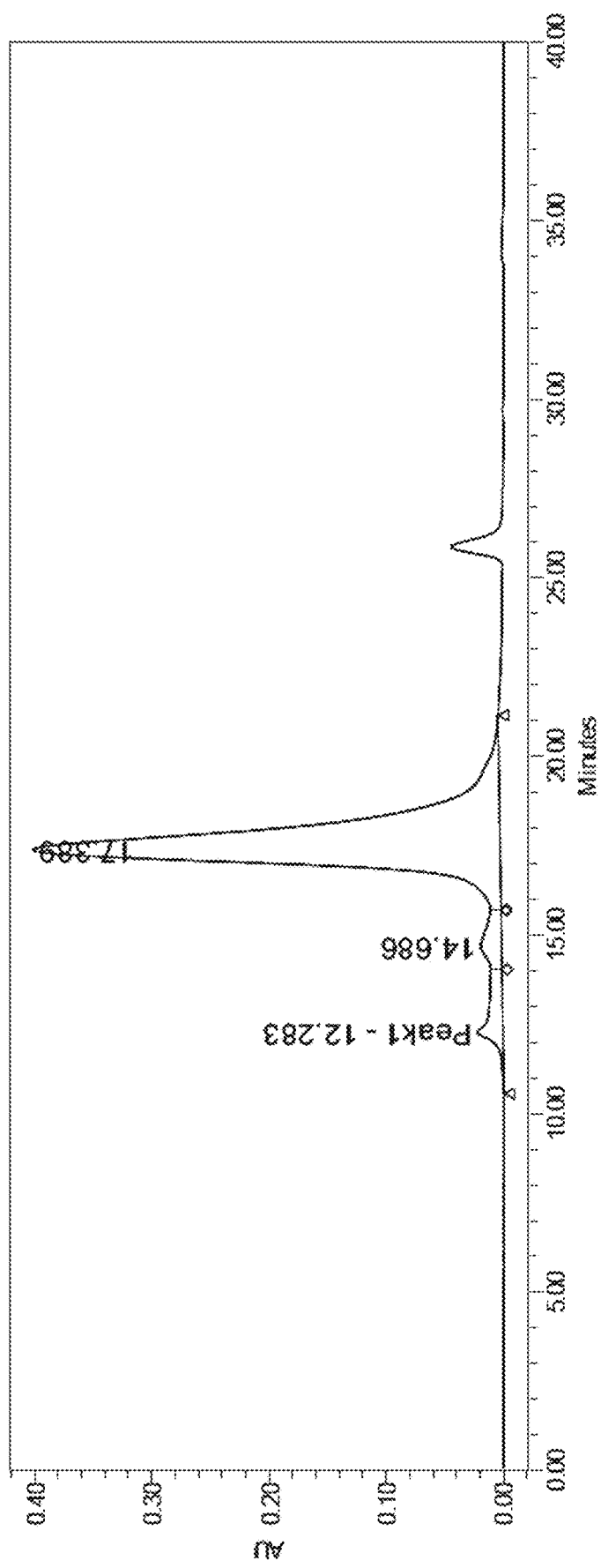
Figure 22C:
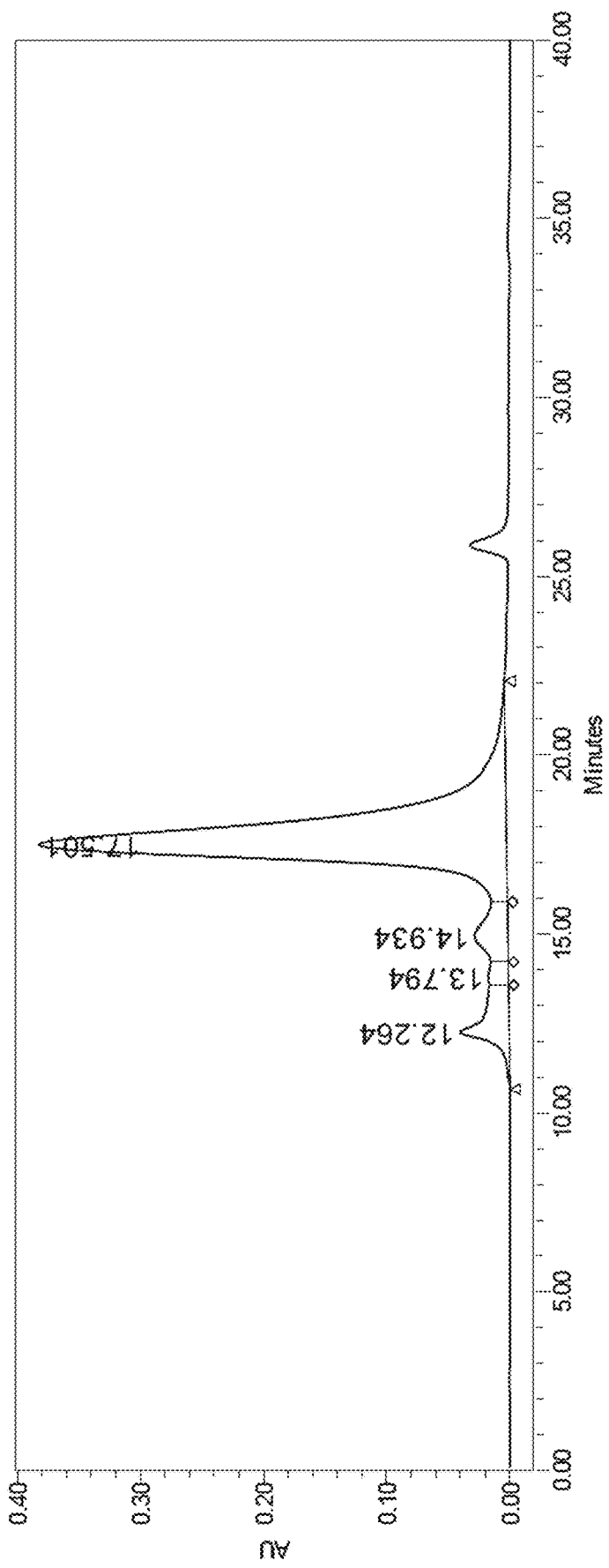
Figure 22D:
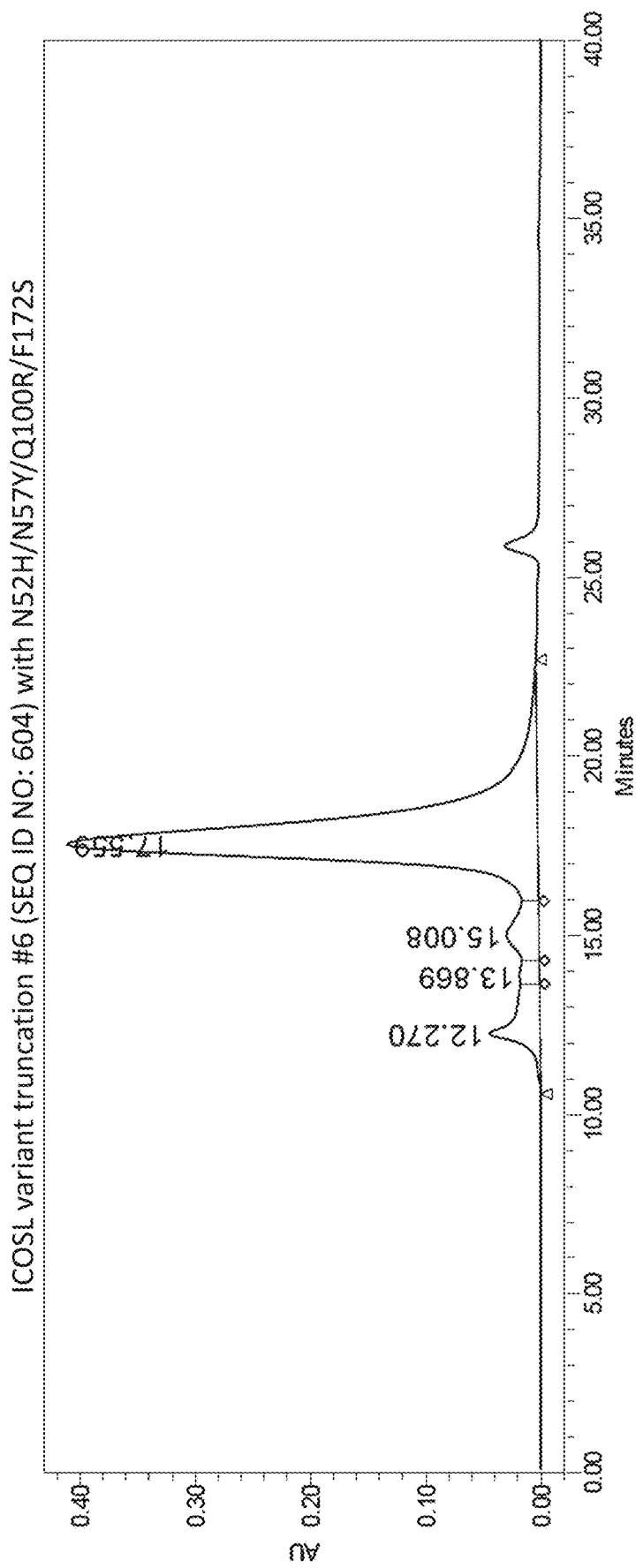
Figure 22E:
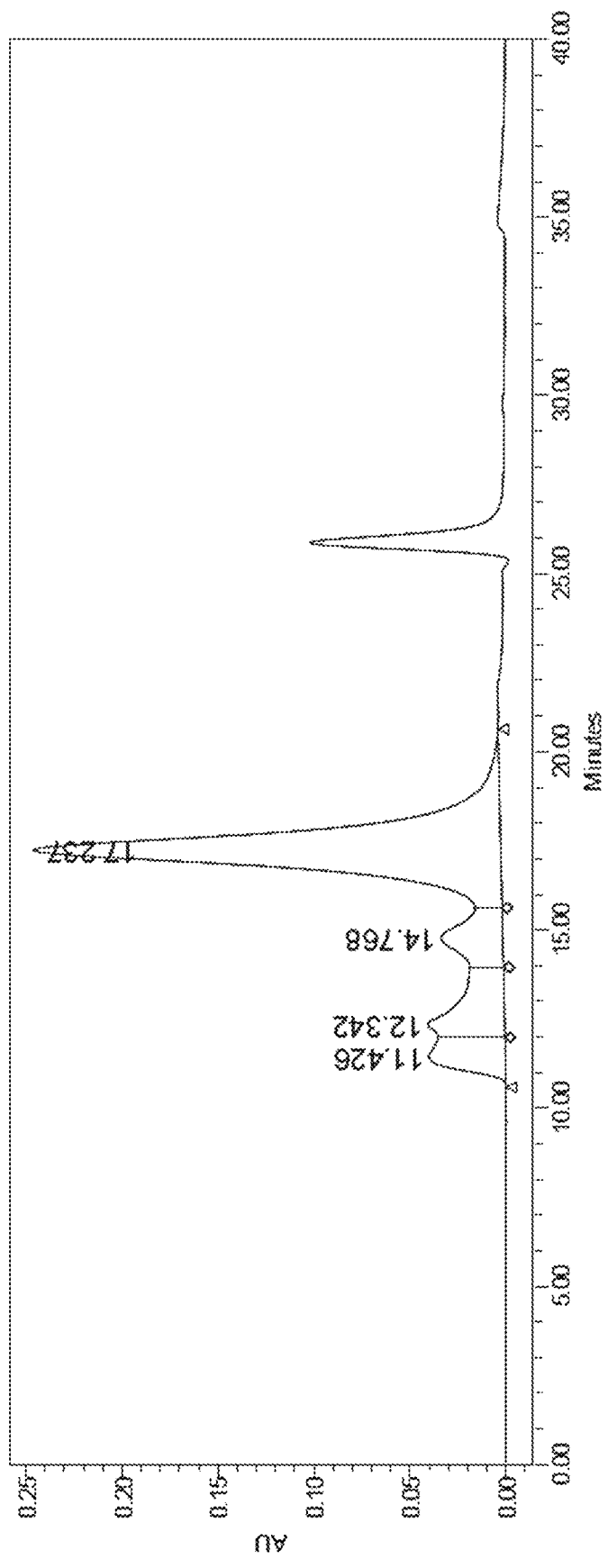
Figure 22F:
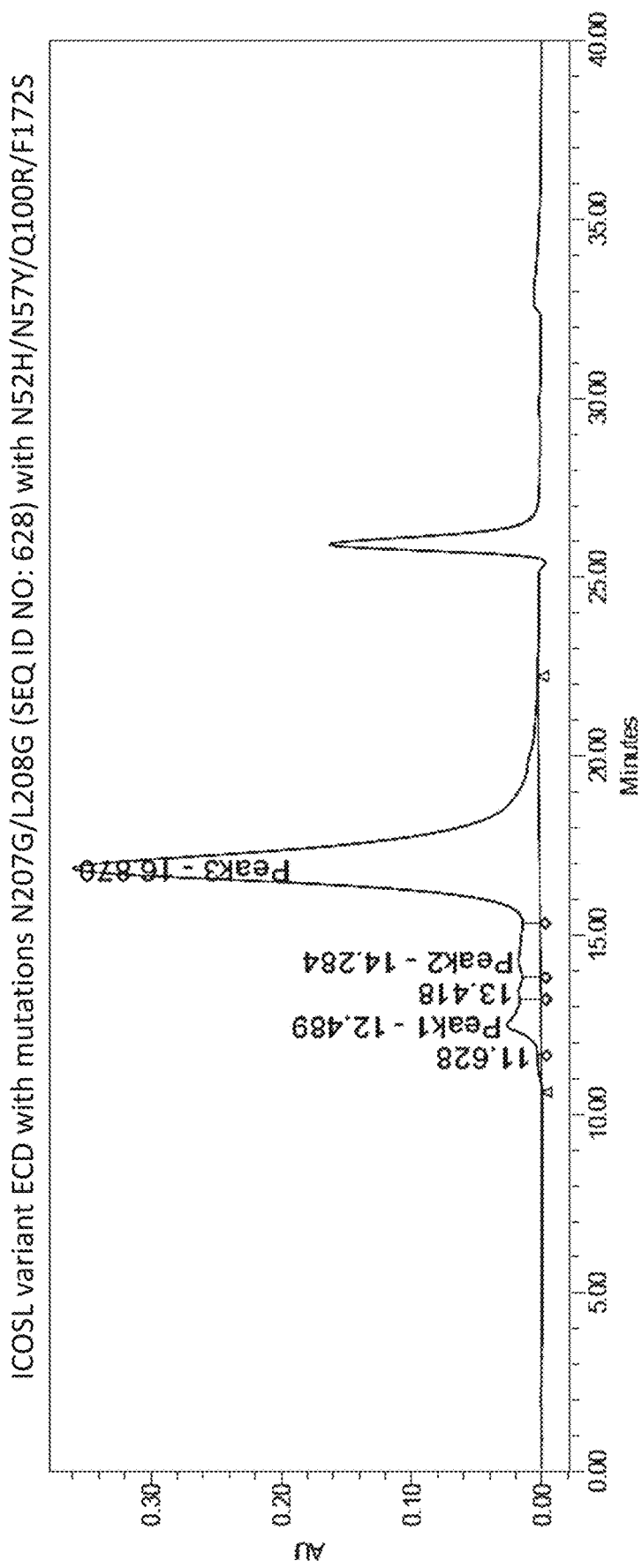

By SEC, intact protein displayed as a single peak while clipped protein displayed as multiple peaks, including lower molecular weight species. Consistent with the SDS-PAGE results described in Example 26, proteolysis as assessed by SEC was observed when variant ICOSL ECD Fc-fusion protein was expressed in ExpiCHO-S derived cells, as indicated by the multiple peaks shown in FIG. 22A. As shown in FIGS. 22B-22G, single peaks were observed by SEC analysis of the variant ICOSL Fc fusion proteins generated using modified reference ICOSL polypeptides in which the putative ECD protease cleavage site was removed or mutated, indicating reduced cleavage of the proteins occurred. In one purification lot, however, lower molecular weight species were observed by SEC analysis of the variant ICOSL Fc fusion protein generated using the reference ICOSL polypeptide set forth in SEQ ID NO: 604 (Trunc. #5), although it was not clear the reason for the presence of these species in this lot. As shown in FIG. 22G, the generation of lower molecular weight species, and hence proteolysis, also was not observed by SEC analysis of the variant ICOSL Fc-fusion proteins generated using the ICOSL IgV alone reference sequence.

B. Binding and Activity

Binding and activity of protein produced and purified following transfection of DNA constructs encoding the variant ICOSL Fc-fusion immunomodulatory proteins in various reference sequences described above in CHO cells was compared. In some cases, purified clones as assessed below were later found to contain additional mutations beyond those described above, which were not believed to impact the immunomodulatory activity of the tested proteins.

The resulting purified variant ICOSL Fc-fusion immunomodulatory proteins were assessed for binding to cognate binding partners and for modulation of T cell activity using a mixed lymphocyte reaction (MLR) substantially as described above. Table 30C indicates amino acid substitutions in the ICOSL reference sequence as designated by amino acid position number corresponding to amino acid positions in the respective reference (e.g., unmodified) ICOSL extracellular domain (ECD) sequence set forth in SEQ ID NO: 32, and sets forth the SEQ ID NO identifier for each ICOSL reference sequence. As shown, the binding and MLR antagonist activity was generally similar for all tested formats.

ICOSL reference sequences as set forth in Table 30D, also were linked to an inert Fc containing mutations C220S/L234A/L235E/G237A by EU numbering set forth in SEQ ID NO: 477, and were produced and purified following transfection of 293 or CHO cells with the DNA constructs. In addition, an exemplary variant immunomodulatory protein was generated as a monomer in which cells were transfected with a DNA construct encoding the variant in the variant ICOSL ECD reference sequence but without fusion with an Fc sequence.

The resulting purified variant ICOSL Fc-fusion proteins or variant ICOSL monomer were assessed for binding to cognate binding partners and for modulation of T cell activity using a mixed lymphocyte reaction (MLR) substantially as described above. Table 30D indicates amino acid substitutions in the reference sequence of the variant ICOSL as designated by amino acid position number corresponding to amino acid positions in the respective reference (e.g.,

TABLE 30C

Molecule sequences, binding data, and costimulatory bioactivity data of variant ICOSL molecules

| Description | Reference Sequence SEQ ID NO | Binding CD28 MFI ($\Delta$WT) | Binding CTLA-4 MFI ($\Delta$WT) | Binding ICOS MFI ($\Delta$WT) | MLR IFN-gamma pg/mL ($\Delta$WT) |
|---|---|---|---|---|---|
| ICOSL ECD Truncation #7 with N52H/N57Y/Q100R/F172S and F83S | 605 | 88329 (51.1) | 206566 (27.3) | 106493 (1.1) | 12 (0.02) |
| ICOSL ECD Truncation #6 with N52H/N57Y/Q100R/F172S | 604 | 91273 (52.8) | 239746 (31.6) | 90074 (0.9) | 14 (0.02) |
| ICOSL ECD Truncation #4 with N52H/N57Y/Q100R/F172S and E200G | 602 | 80555 (46.6) | 320229 (42.3) | 107957 (1.1) | 9 (0.01) |
| ICOSL ECD Truncation #4 with N52H/N57Y/Q100R/F172S | 602 | 68599 (39.7) | 377254 (49.8) | 132880 (1.3) | 2 (0.00) |
| ICOSL ECD Truncation #8 with N207G/L208G and N52H/N57Y/Q100R/F172S | 606 | 107837 (62.4) | 308427 (40.7) | 132654 (1.3) | 8 (0.01) |
| ICOSL IgV with N52H/N57Y/Q100R and H48R/S54P | 545 | 75304 (43.6) | 321613 (42.4) | 143141 (1.4) | 995 (1.31) |
| ICOSL ECD with N52H/N57Y/Q100R/F172S | 32 | 110407 (63.9) | 323219 (42.6) | 136060 (1.4) | 0 (0.00) |
| ICOSL ECD Truncation #7 with N52H/N57Y/Q100R/C198R and E90K/E111G | 605 | 38876 (22.5) | 83695 (11.0) | 54596 (0.5) | 761 (1.00) |
| ICOSL ECD Truncation #6 with N52H/N57Y/Q100R/C198R | 604 | 84566 (49.0) | 236011 (31.1) | 91357 (0.9) | 7 (0.01) |
| ICOSL ECD Truncation #5 with N52H/N57Y/Q100R/C198R | 603 | 86289 (50.0) | 216071 (28.5) | 110188 (1.1) | 9 (0.01) |
| ICOSL ECD Truncation #8 with N207G/L208G and N52H/N57Y/Q100R/C198R and Y151H | 606 | 94156 (54.5) | 368471 (48.6) | 142900 (1.4) | 2 (0.00) |
| ICOSL IgV with N52H/N57Y/Q100R | 545 | 84594 (49.0) | 204840 (27.0) | 117707 (1.2) | 0 (0.00) |
| ICOSL ECD with N52H/N57Y/Q100R/C198R | 32 | 59179 (34.3) | 132894 (17.5) | 138555 (1.4) | 0 (0.00) |
| Wildtype ICOSL ECD | 32 | 1727 (1.0) | 7579 (1.0) | 100466 (1.0) | 757 (1.00) |

C. Binding and Activity of Proteins Expressed in 293 (Expi293) or CHO Cells

The variant ICOSL Fc fusion proteins, generated based on ICOSL reference sequences described above, were assessed for binding and activity following expression in 293 (Expi293) or CHO cells. In addition, a DNA construct encoding exemplary IgSF domain ICOSL variants N52H/N57Y/Q100R/C198R or N52H/Q100R, in exemplary unmodified) ICOSL extracellular domain (ECD) sequence set forth in SEQ ID NO:32, and sets forth the SEQ ID NO identifier for each reference ICOSL sequence. Column 3 indicates the cell type (ExpiCHO-S or Exp1293) used to produce the ICOSL protein. As shown in Table 30D, the results indicate substantially similar binding and activity, whether or not the variant ICOSL immunomodulatory protein was produced in CHO or 293 cells.

TABLE 30D

Molecule sequences, binding data, and costimulatory bioactivity data of variant ICOSL ECD Fc-fusion molecules produced using various cells

| Description | Reference Sequence SEQ ID NO | CHO or 293 Material | Binding CD28 MFI (ΔWT) | Binding CTLA-4 MFI (ΔWT) | Binding ICOS MFI (ΔWT) | MLR IFN-gamma pg/mL (ΔWT) |
|---|---|---|---|---|---|---|
| ICOSL ECD with N52H/N57Y/Q100R/C198R | 32 | 293 | 13710 (3.9) | 8715 (0.7) | 16746 (1.4) | 20 (0.02) |
| ICOSL ECD with N52H/N57Y/Q100R/C198R | 32 | CHO | 12876 (3.6) | 8750 (0.7) | 7700 (0.7) | 16 (0.02) |
| ICOSCL ECD with N52H/Q100R | 32 | 293 | 11664 (3.3) | 13429 (1.1) | 10284 (0.9) | 168 (0.19) |
| ICOSCL ECD with N52H/N57Y/Q100R/F172S | 32 | 293 | 12900 (3.6) | 8179 (0.7) | 15956 (1.4) | 14 (0.02) |
| ICOSCL ECD with N52H/N57Y/Q100R/F172S | 32 | CHO | 14437 (4.1) | 8708 (0.7) | 12610 (1.1) | 21 (0.02) |
| ICOSCL IgV with N52H/N57Y/Q100R | 545 | 293 | 16618 (4.7) | 9674 (0.8) | 9377 (0.8) | 10 (0.01) |
| ICOSCL IgV with N52H/N57Y/Q100R | 545 | CHO | 17343 (4.9) | 9039 (0.7) | 8673 (0.7) | 14 (0.01) |
| ICOSL ECD Truncation #4 with N52H/N57Y/Q100R/F172S | 602 | 293 | 14710 (4.1) | 8841 (0.7) | 6893 (0.6) | 21 (0.02) |
| ICOSL ECD Truncation #4 with N52H/N57Y/Q100R/F172S | 602 | CHO | 12743 (3.6) | 9000 (0.7) | 7606 (0.7) | 21 (0.02) |
| ICOSL ECD Truncation #7 with N52H/N57Y/Q100R/F172S | 605 | 293 | 12017 (3.4) | 9674 (0.8) | 7599 (0.7) | 15 (0.02) |
| ICOSL ECD Truncation #7 with N52H/N57Y/Q100R/F172S | 605 | CHO | 13043 (3.7) | 9039 (0.7) | 8077 (0.7) | 7 (0.01) |
| ICOSL ECD Monomer with N52H/N57Y/Q100R no Fc | 32 | 293 | 20575 (5.8) | 19978 (1.6) | 11989 (1.0) | 133 (0.15) |
| ICOSL ECD Dimer with N52H/N57Y/Q100R no Fc | 32 | 293 | 18477 (5.2) | 22361 (1.8) | 12913 (1.1) | 119 (0.13) |
| Wildtype ICOSL ECD | 32 | 293 | 3556 (1.0) | 12121 (1.0) | 11690 (1.0) | 905 (1.00) |

Example 28

Generation of NNK Variant Library of ICOSL IgSF Domain Variants and Assessment of Binding and Activity Additional variant ICOSL IgSF domain-containing molecules were generated with mutations at position 52, 57, and 100 with reference to positions set forth in SEQ ID NO:32. The variants were generated from an NNK library, where K=T or G, such that the encoding codons encode all potential amino acids, but prevent the encoding of two stop residues TAA and TGA. The NNK library DNA was introduced into yeast substantially as described in Example 2 to generate yeast libraries. The libraries were used to select yeast expressing affinity modified variants of ICOSL substantially as described in Example 3.

The selected variant ICOSL IgSF domain-containing molecules were further formatted as an Fc-fusion protein substantially as described in Example 4 except containing the generated ICOSL IgSF domain linked via a GSGGGGS linker (SEQ ID NO:635) to an inert Fc containing mutations C220S/L234A/L235E/G237A/K447del by EU numbering set forth in SEQ ID NO: 633, or an allotype thereof set forth in SEQ ID NO:637.

The variant ICOSL Fc-fusion immunomodulatory proteins were assessed in binding studies to assess binding for cognate binding partners. Expi293 cells transfected with cognate binding partners, human CD28, ICOS and CTLA4, were used as target cells in binding studies as described in Example 6. MFI of binding of 100 nM of variant ICOSL Fc fusion immunomodulatory proteins for target cells expressing each binding partner was determined and compared for binding of the corresponding reference (e.g., unmodified or wildtype) ICOSL IgV-Fc for the same target cell. The costimulatory bioactivity of generated ICOSL variant Fc-fusion molecules was also assessed in anti-CD3 (10 mM) coimmobilization assays as described in Example 6. Modulation of T cell activity by the variant ICOSL Fc-fusion immunomodulatory proteins was also determined using a mixed lymphocyte reaction (MLR) with 1 nM ICOSL-Fc substantially as described in Example 6. IFN-gamma secretion from triplicate wells was determined.

Results for binding and functional activity, based on costimulatory bioactivity or activity in an MLR assay, for exemplary variant ICOSL IgV-Fc fusion molecules are shown in Table 31. The Table below indicates amino acid substitutions in the variant ICOSL as designated by amino acid position number corresponding to amino acid positions in the respective reference (e.g., unmodified) ICOSL extracellular domain (ECD) sequence set forth in SEQ ID NO:32. Column 2 sets forth the SEQ ID NO identifier for each variant IgV domain contained in the variant IgV-Fc fusion molecule. As shown, the ICOSL IgSF (e.g. IgV) domain variants generated with the various combinations of specific mutations at positions 52, 57, and 100, exhibited altered binding for at least one, and in some cases more than one, cognate binding partner. The last two columns of the Table also depict the functional activity of the variant Fc-fusion molecules to modulate the activity of T cells based on the calculated levels of IFN-gamma in culture supernatants (pg/mL) generated either i) with the indicated variant IgV-Fc fusion soluble molecule coimmoblized with anti-CD3 or ii) with the indicated variant IgV-Fc fusion molecule in an MLR assay. The Table also depicts the ratio of IFN-gamma produced by each variant ECD-Fc compared to the corresponding reference (e.g., unmodified or wild-type) ECD-Fc in both functional assays. Variant Fc-fusion proteins also exhibited altered immunological activity. Costimulatory signaling of some variant molecules was substantially greater compared to wild-type ICOSL. Certain variants exhibited substantial inhibition of IFN-gamma with very low to no detectable IFN-gamma produced in the cultures in the MLR assay.

TABLE 31

Additional exemplary variant ICOSL polypeptides

| Mutations | SEQ ID NO (IgV) | Binding CD28 MFI (ΔWT) | Binding CTLA-4 MFI (ΔWT) | Binding ICOS MFI (ΔWT) | Costim IFN-gamma pg/mL (ΔWT) | MLR IFN-gamma pg/mL (ΔWT) |
|---|---|---|---|---|---|---|
| N52A/N57F/Q100S | 734 | 156589 (7.00) | 255078 (0.77) | 241891 (1.14) | 1119 (0.68) | 0 (0.00) |
| N52A/N57H/Q100S | 735 | 159363 (7.10) | 321437 (0.97) | 304600 (1.44) | 2972 (1.80) | 0 (0.00) |
| N52A/N57Y/Q100A | 736 | 147258 (6.60) | 319745 (0.97) | 260713 (1.23) | 2978 (1.81) | 0 (0.00) |
| N52D/N57A/Q100A | 737 | 137882 (6.20) | 340186 (1.03) | 248975 (1.17) | 477 (0.29) | 134 (0.60) |
| N52D/Q100S | 738 | 95731 (4.30) | 332743 (1.01) | 275097 (1.30) | 957 (0.58) | 110 (0.49) |
| N52G/Q100A | 739 | 98652 (4.40) | 97118 (0.29) | 303229 (1.43) | 296 (0.18) | 96 (0.43) |
| N52H/Q100A | 740 | 145762 (6.50) | 361334 (1.09) | 213008 (1.01) | 784 (0.48) | 37 (0.17) |
| N52M/N57H/Q100S | 741 | 114743 (5.10) | 463404 (1.40) | 265637 (1.25) | 1333 (0.81) | 0 (0.00) |
| N52M/N57W/Q100P | 742 | 168057 (7.50) | 342659 (1.04) | 322277 (1.52) | 1865 (1.13) | 0 (0.00) |
| N52Q/N57F | 743 | 131301 (5.90) | 366714 (1.11) | 192206 (0.91) | 1403 (0.85) | 0 (0.00) |
| N52Q/N57S/Q100A | 744 | 91306 (4.10) | 315021 (0.95) | 262735 (1.24) | 290 (0.18) | 123 (0.55) |
| N52R/ N57L/Q100A | 745 | 118803 (5.30) | 402961 (1.22) | 307965 (1.45) | 709 (0.43) | 0 (0.00) |
| N52R/N57Y/Q100P | 746 | 133283 (6.00) | 502179 (1.52) | 251264 (1.19) | 7380 (4.48) | 0 (0.00) |
| N52R/N57Y/Q100S | 747 | 133454 (6.00) | 504037 (1.53) | 229271 (1.08) | 5841 (3.54) | 0 (0.00) |
| N52S/N57A/Q100A | 748 | 98153 (4.40) | 233184 (0.71) | 181297 (0.86) | 442 (0.27) | 52 (0.23) |
| N52S/N57H/Q100E | 749 | 116821 (5.20) | 302383 (0.92) | 257518 (1.22) | 8412 (5.11) | 132 (0.59) |
| N52S/N57L/Q100S | 750 | 108133 (4.80) | 197064 (0.60) | 268940 (1.27) | 3120 (1.89) | 0 (0.00) |
| N52S/ N57M/Q100S | 751 | 133604 (6.00) | 227615 (0.69) | 312088 (1.47) | 349 (0.21) | 199 (0.89) |
| N52S/N57Y/Q100S | 752 | 161330 (7.20) | 204577 (0.62) | 223684 (1.06) | 7411 (4.50) | 0 (0.00) |
| N52S/N57Y/Q100M | 753 | 156869 (7.00) | 395350 (1.20) | 302569 (1.43) | 2954 (1.79) | 0 (0.00) |
| N52S/N57Y/Q100V | 754 | 126281 (5.70) | 304795 (0.92) | 218925 (1.03) | 1304 (0.79) | 0 (0.00) |
| N52T/N57H/Q100S | 755 | 143441 (6.40) | 377542 (1.14) | 258634 (1.22) | 6312 (3.83) | 0 (0.00) |
| N52T/N57H/Q100A | 756 | 112637 (5.00) | 350453 (1.06) | 220339 (1.04) | 2874 (1.74) | 0 (0.00) |
| N52T/N57Y/Q100A | 757 | 161333 (7.20) | 340845 (1.03) | 239136 (1.13) | 442 (0.27) | 0 (0.00) |
| N52V/N57L/Q100A | 758 | 132144 (5.90) | 252148 (0.76) | 181344 (0.86) | 518 (0.31) | 159 (0.71) |
| N52H/N57Y/Q100K | 759 | 141720 (6.30) | 393476 (1.19) | 214270 (1.01) | 12919 (7.84) | 0 (0.00) |
| N52K/N57Y/Q100R | 760 | 140729 (6.30) | 233283 (0.71) | 198941 (0.94) | 12515 (7.60) | 0 (0.00) |
| N52L/N57H/Q100R | 761 | 140807 (6.30) | 352518 (1.07) | 250052 (1.18) | 12544 (7.61) | 0 (0.00) |
| N52R/N57F/Q100N | 762 | 161029 (7.20) | 233254 (0.71) | 252904 (1.19) | 448 (0.27) | 106 (0.47) |
| N52R/N57F/Q100P | 763 | 153850 (6.90) | 503696 (1.52) | 296566 (1.40) | 1718 (1.04) | 0 (0.00) |
| N52R/N57F/Q100R | 764 | 185231 (8.30) | 463873 (1.40) | 234248 (1.11) | 11402 (6.92) | 0 (0.00) |
| N52R/N57F/Q100T | 765 | 126875 (5.70) | 357505 (1.08) | 270134 (1.27) | 272 (0.17) | 0 (0.00) |
| N52R/N57H/Q100K | 766 | — | — | — | — | — |
| N52R/N57L/Q100S | 767 | 111704 (5.00) | 289326 (0.88) | 230617 (1.09) | 1292 (0.78) | 0 (0.00) |
| N52R/N57W/Q100K | 768 | 130875 (5.90) | 477268 (1.44) | 349316 (1.65) | 10056 (6.10) | 0 (0.00) |
| N52R/N57W | 769 | 136967 (6.10) | 318199 (0.96) | 298850 (1.41) | 12652 (7.68) | 0 (0.00) |
| N52R/N57Y/Q100R | 770 | 3285 (0.10) | 4266 (0.01) | 6104 (0.03) | 349 (0.21) | 347 (1.54) |
| N52C/N57E/Q100S | 771 | 13361 (0.60) | 10616 (0.03) | 125274 (0.59) | 296 (0.18) | 372 (1.65) |
| N52G/N57P/Q100D | 772 | 5715 (0.30) | 10181 (0.03) | 274629 (1.30) | 254 (0.15) | 343 (1.53) |
| N52G/N57V/Q100G | 773 | 23658 (1.10) | 14727 (0.04) | 260057 (1.23) | 325 (0.20) | 245 (1.09) |
| N52G/N57V | 774 | 69117 (3.10) | 52498 (0.16) | 332068 (1.57) | 847 (0.51) | 327 (1.45) |
| N52L/N57V | 775 | 54775 (2.50) | 150970 (0.46) | 256730 (1.21) | 986 (0.60) | 270 (1.20) |
| N52P/N57P | 776 | 21008 (0.90) | 27043 (0.08) | 222171 (1.05) | 260 (0.16) | 478 (2.13) |
| N52P/N57S/Q100G | 777 | 6803 (0.30) | 5054 (0.02) | 143255 (0.68) | 110 (0.07) | 481 (2.14) |
| N52S/N57L/Q100G | 778 | 71895 (3.20) | 79432 (0.24) | 275602 (1.30) | 726 (0.44) | 513 (2.28) |
| N52T/N57K/Q100P | 779 | 88653 (4.00) | 78299 (0.24) | 312905 (1.48) | 116 (0.07) | 395 (1.76) |
| N52V/N57T/Q100L | 780 | 6205 (0.30) | 11458 (0.03) | 29167 (0.14) | 85 (0.05) | 562 (2.50) |
| N57Q/Q100P | 781 | 15195 (0.70) | 69058 (0.21) | 204533 (0.97) | 159 (0.10) | 432 (1.92) |
| WT ICOSL | 545 | 22340 (1.00) | 330437 (1.00) | 211945 (1.00) | 1648 (1.00) | 225 (1.00) |
| Full length N52H/N57Y/Q100R/F172S | 291 | 138141 (6.20) | 605794 (1.83) | 237653 (1.12) | — | 0 (0.00) |
| N52H/N57Y/Q100R | 565 | 142274 (6.40) | 817010 (2.47) | 199528 (0.94) | — | 0 (0.00) |
| N52H/N57Y/Q100R | 283 | — | — | — | 10362 (6.29) | — |

Example 29

Assessment of K562 Cells Expressing a Transmembrane Immunomodulatory Protein (TIP)

K562 cells were engineered to express a Transmembrane Immunomodulatory Protein (TIP) that contained the ECD of the vIgD ICOSL domains fused to the native transmembrane and intracellular domain of WT human ICOSL set forth in SEQ ID NO: 5. The exemplary variant ICOSL-TIP had an affinity-modified IgSF domain containing amino acid mutations corresponding to N52H/N57Y/Q100P (SEQ ID NO: 288), N52H/N57Y/Q100R (SEQ ID NO: 283), or E16V/N52H/N57Y/Q100R/V110D/H115R/Y152C/K156M/C198R (SEQ ID NO: 300) with reference to positions in the ICOSL extracellular domain set forth in SEQ ID NO:32.

K562 cells (ATCC) were labeled with CFSE to better distinguish them from T cells in co-culture assays. Purified primary human T cells were labeled with Cell Trace Far Red (both from Thermo-Fisher) and co-plated in a 96 well round bottom tissue culture plates with anti-CD3 antibody. To provide a TCR signal for T cells, anti-CD3 antibody was included in soluble format over a range of concentrations that allowed K562 presentation of this stimulating antibody through the Fc-receptor CD32 expressed by the cells. Cells were incubated 72 hours and proliferation of CD4+ (FIG. 23A) and CD8+ (FIG. 23B) was monitored and reported as percent of cells divided versus anti-CD3 concentration. Each point represents the mean of triplicate wells with error bars showing standard deviation.

Figure 23A:
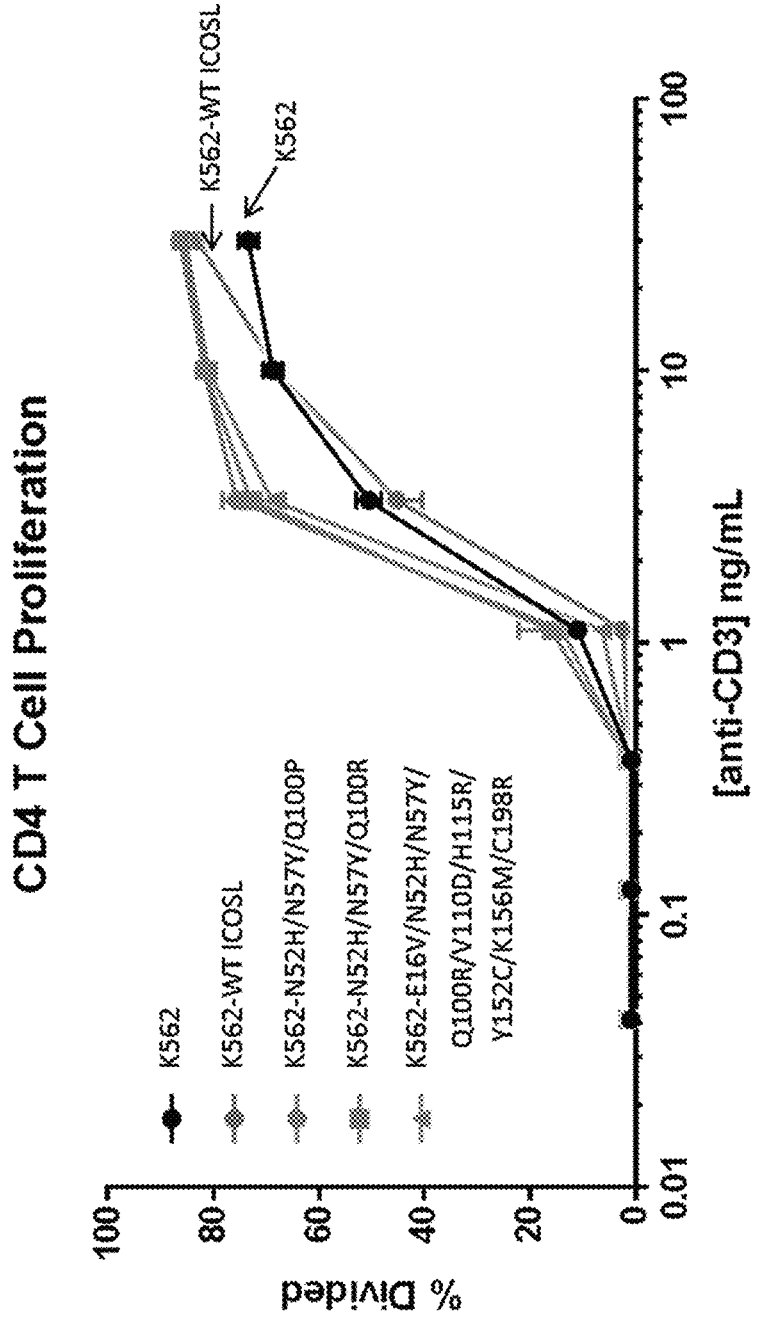
FIGS. 23A-23B depicts the proliferation of CD4 and CD8 human T cells stimulated with K652 cells expressing variant ICOSL TIPs containing an ECD containing an affinity-modified IgSF with amino acid mutations corresponding to N52H/N57Y/Q100P (SEQ ID NO: 288), N52H/N57Y/Q100R (SEQ ID NO: 283), and E16V/N52H/N57Y/Q100R/V110D/H115R/Y152C/K156M/C198R (SEQ ID NO: 300).
Figure 23B:
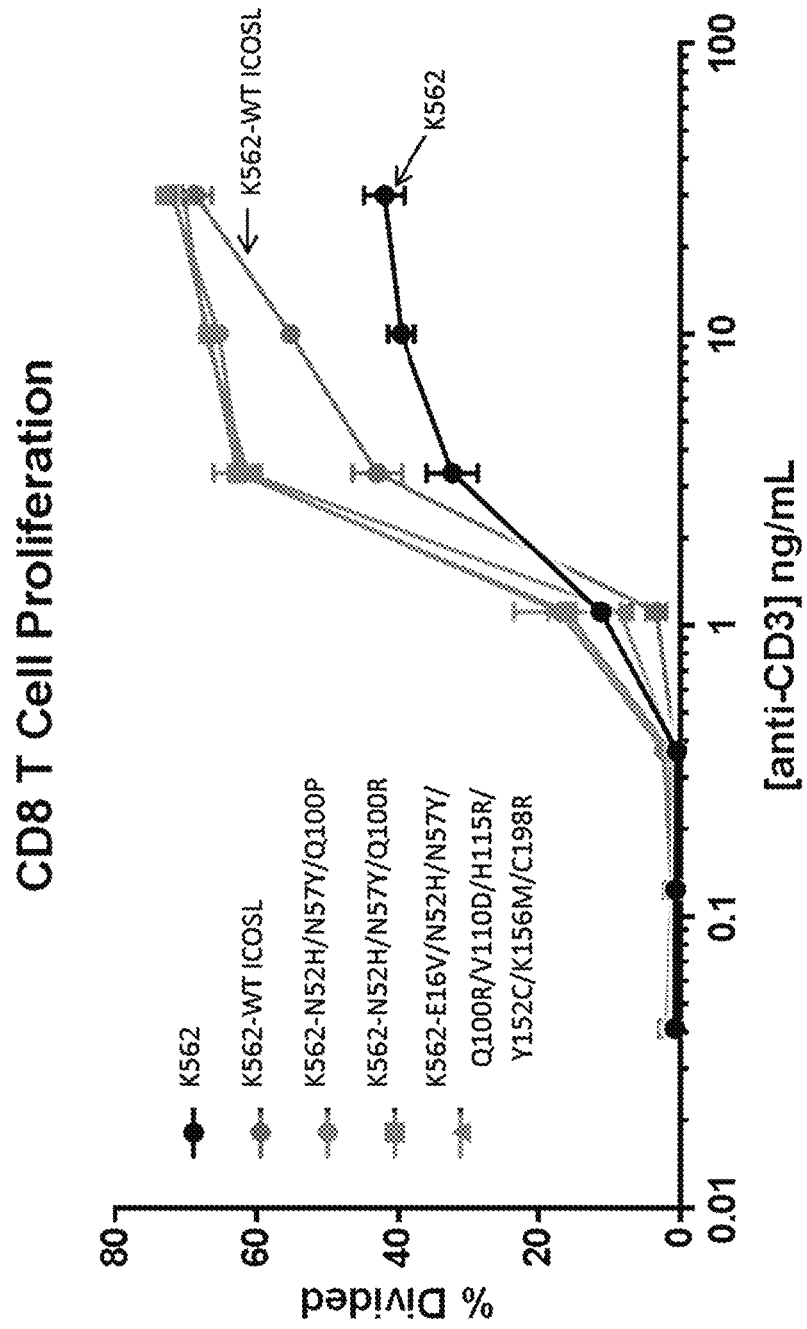

Wild type K562 cells stimulated T cells to proliferate when co-incubated with soluble anti-CD3 antibody in a dose-dependent manner, whereas K562 cells in the absence of anti-CD3 did not. As shown in FIGS. 23A and 23B, expression of WT ICOSL TIP on the surface enhanced responses, but the effects were greater when K562 cells expressed the variant ICOSL TIPs, indicating that these molecules expressed on the surface of cells provided superior costimulation for T cells.

Example 30

Figure 24A:
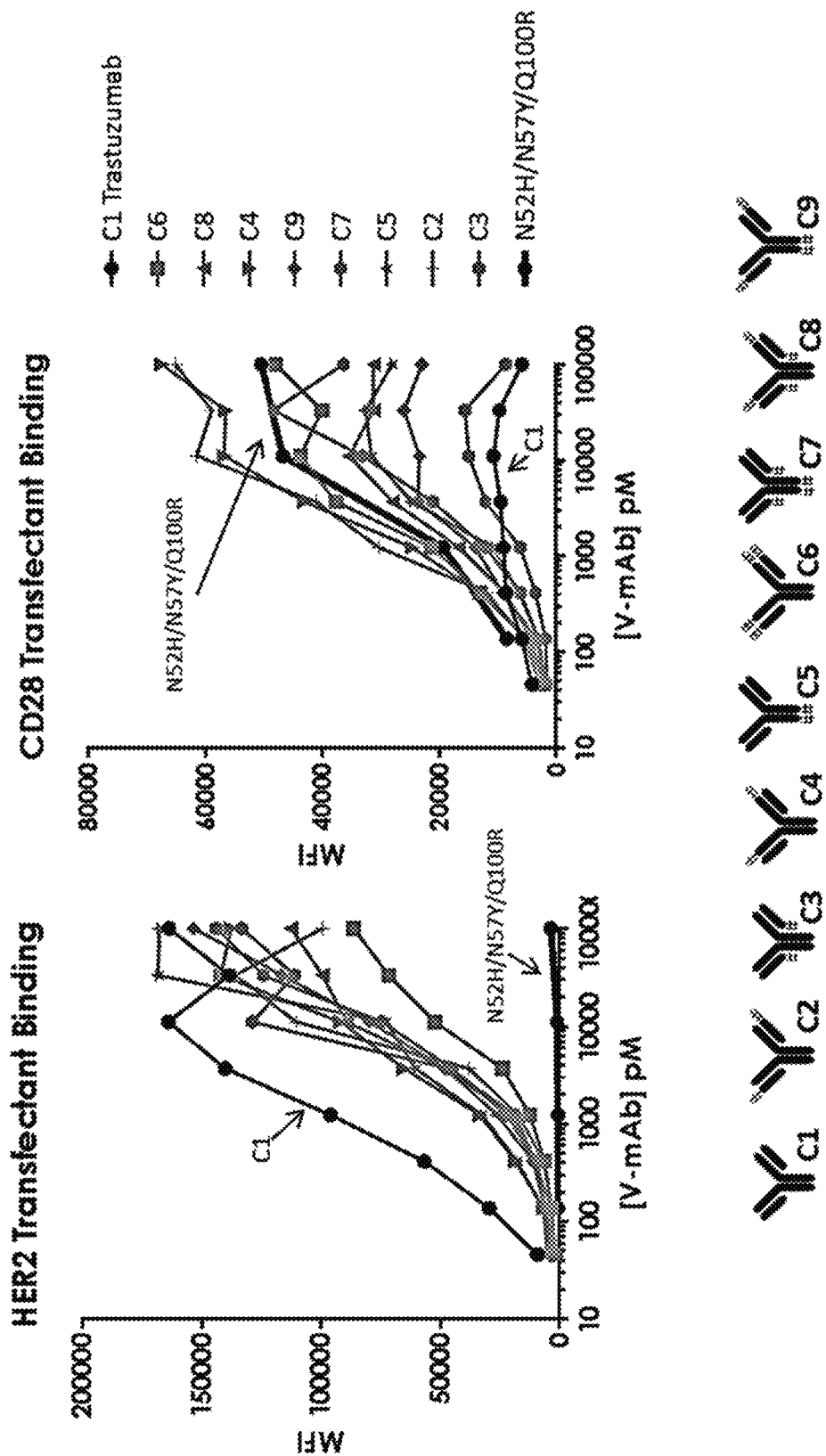
FIG. 24A depicts binding of V-mAbs to HER2 and CD28.
Figure 24C:
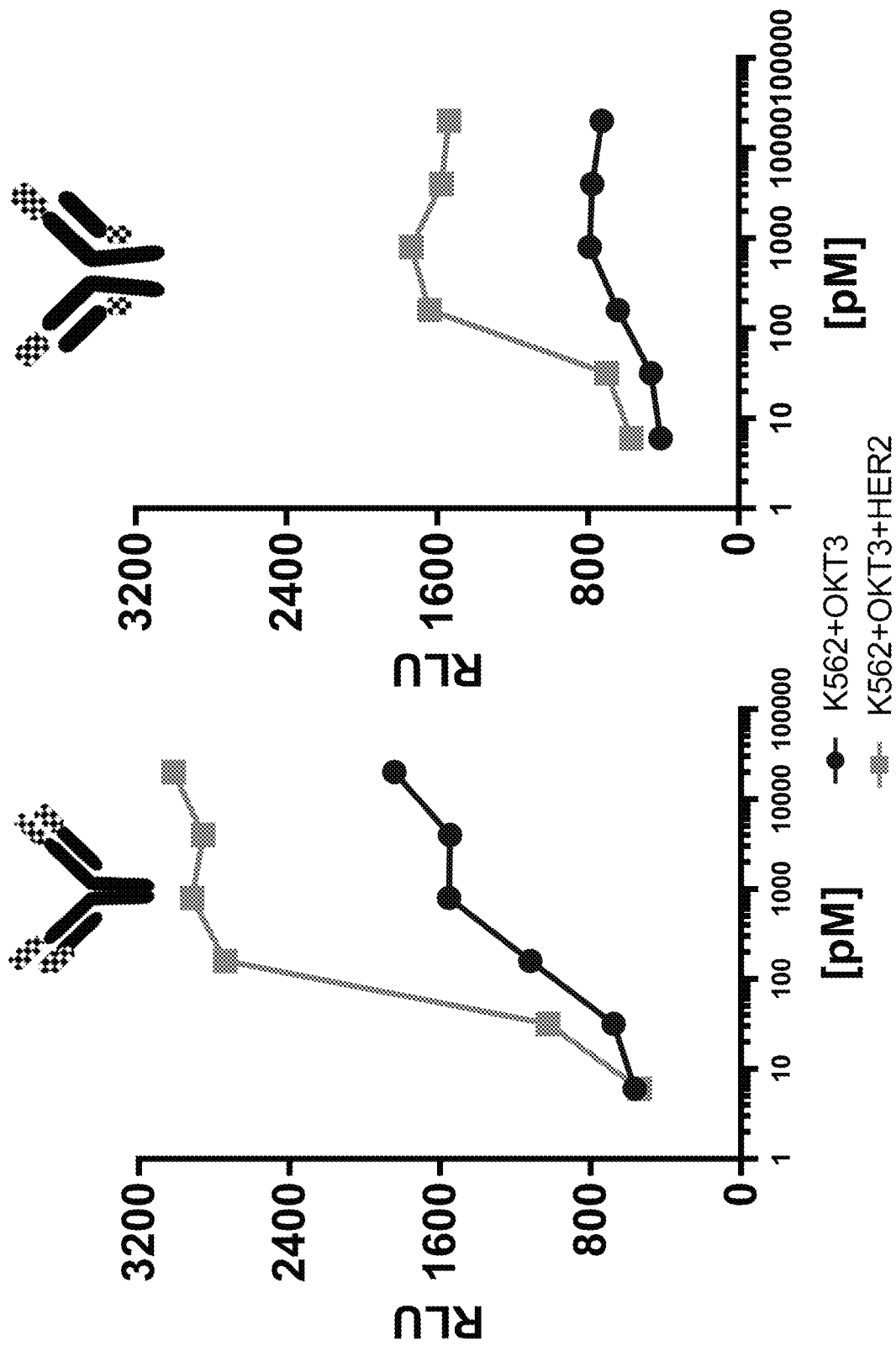
Figure 24D:
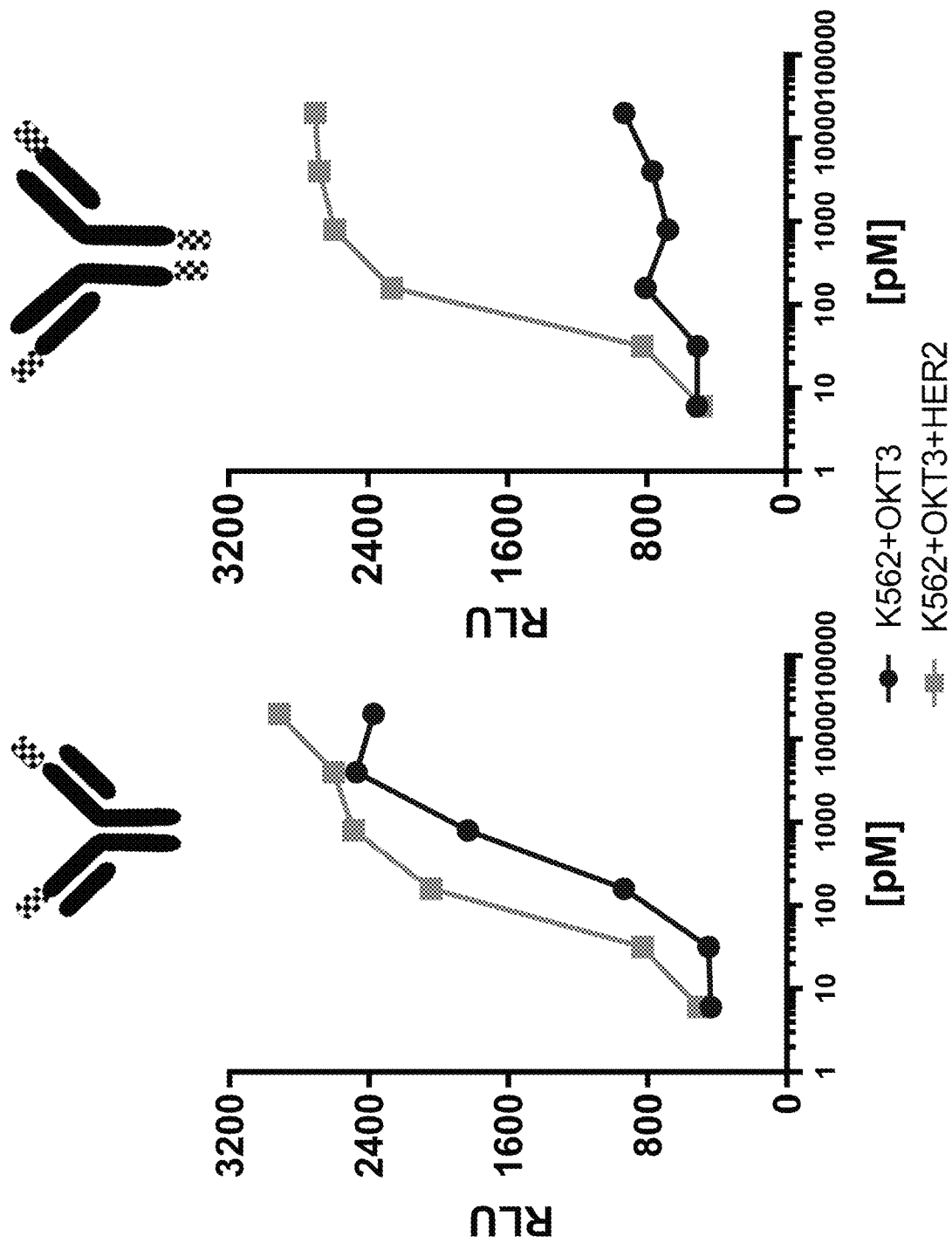
Figure 24E:
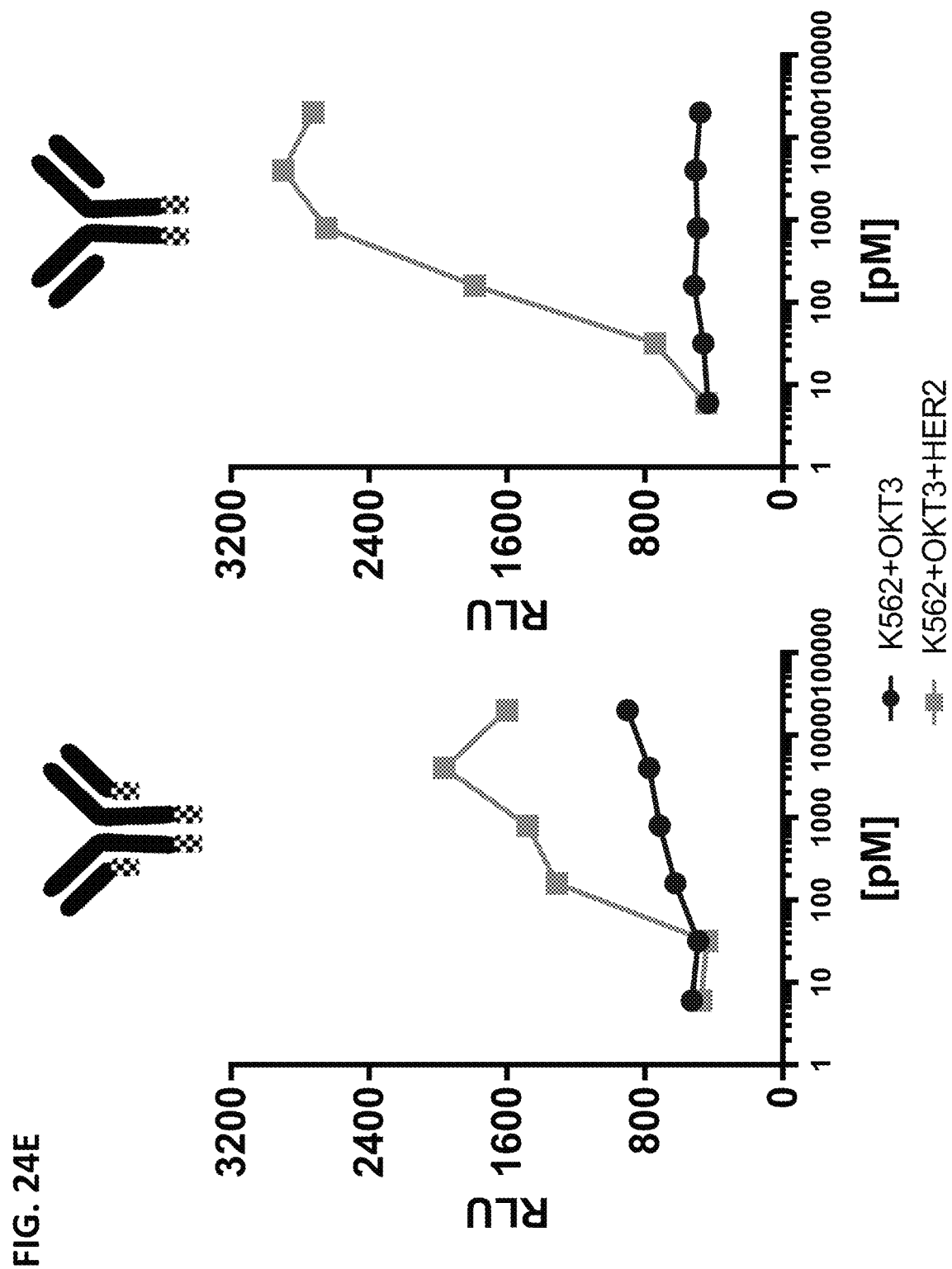
Figure 24F:
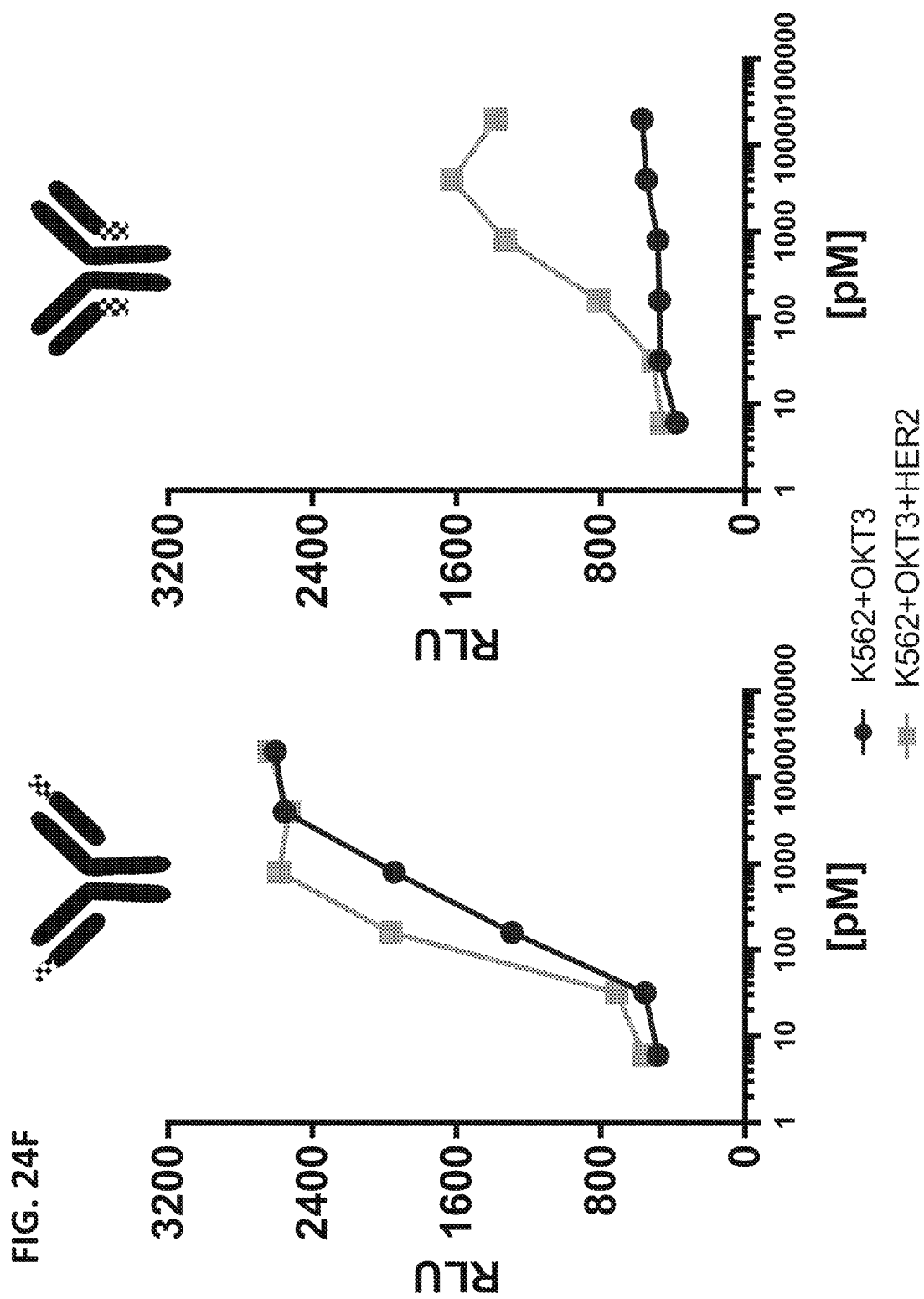
Figure 25A:
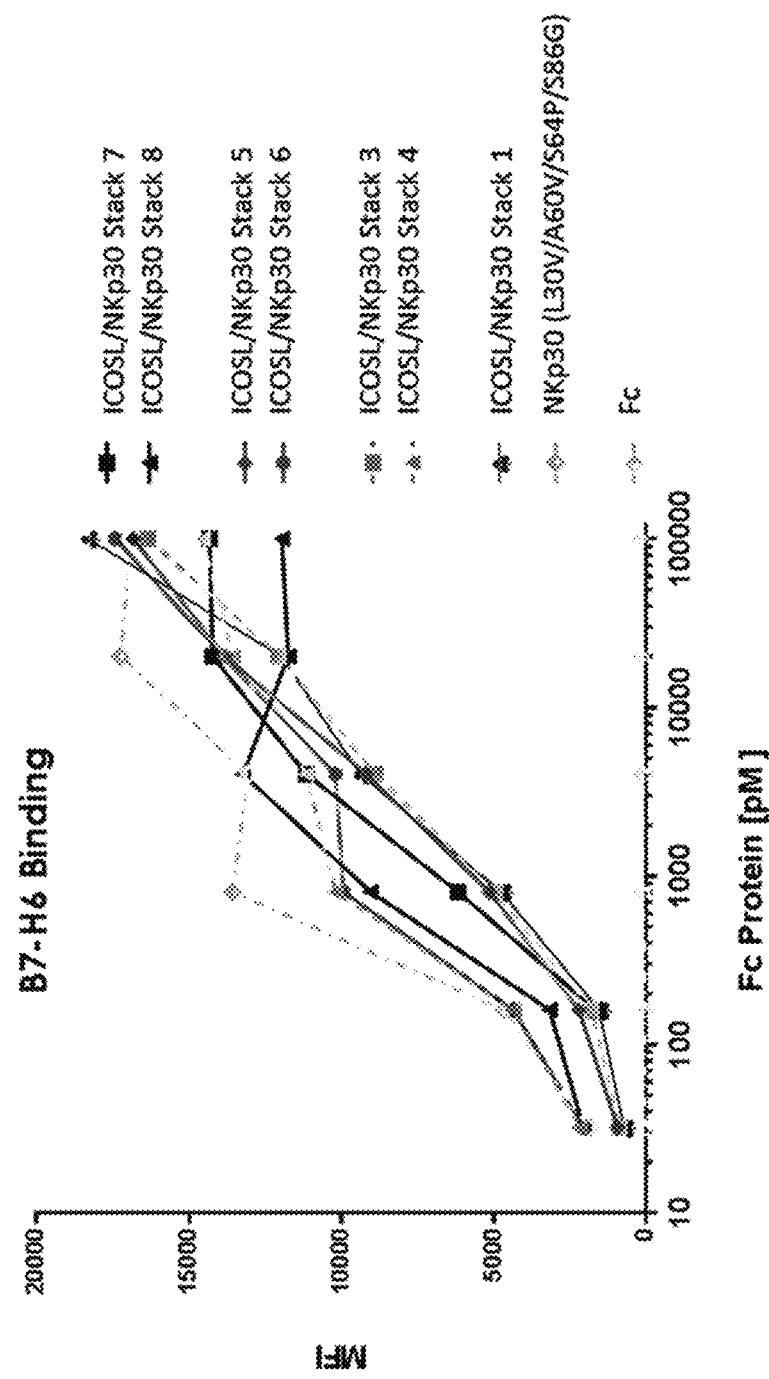
FIGS. 25A-25D depicts binding of stack Fc-fusion molecules to cells expressing cognate binding partners B7H6 (FIG. 25A), ICOS (FIG. 25B), CD28 (FIG. 25C), and CTLA-4 (FIG. 25D).
Figure 25B:
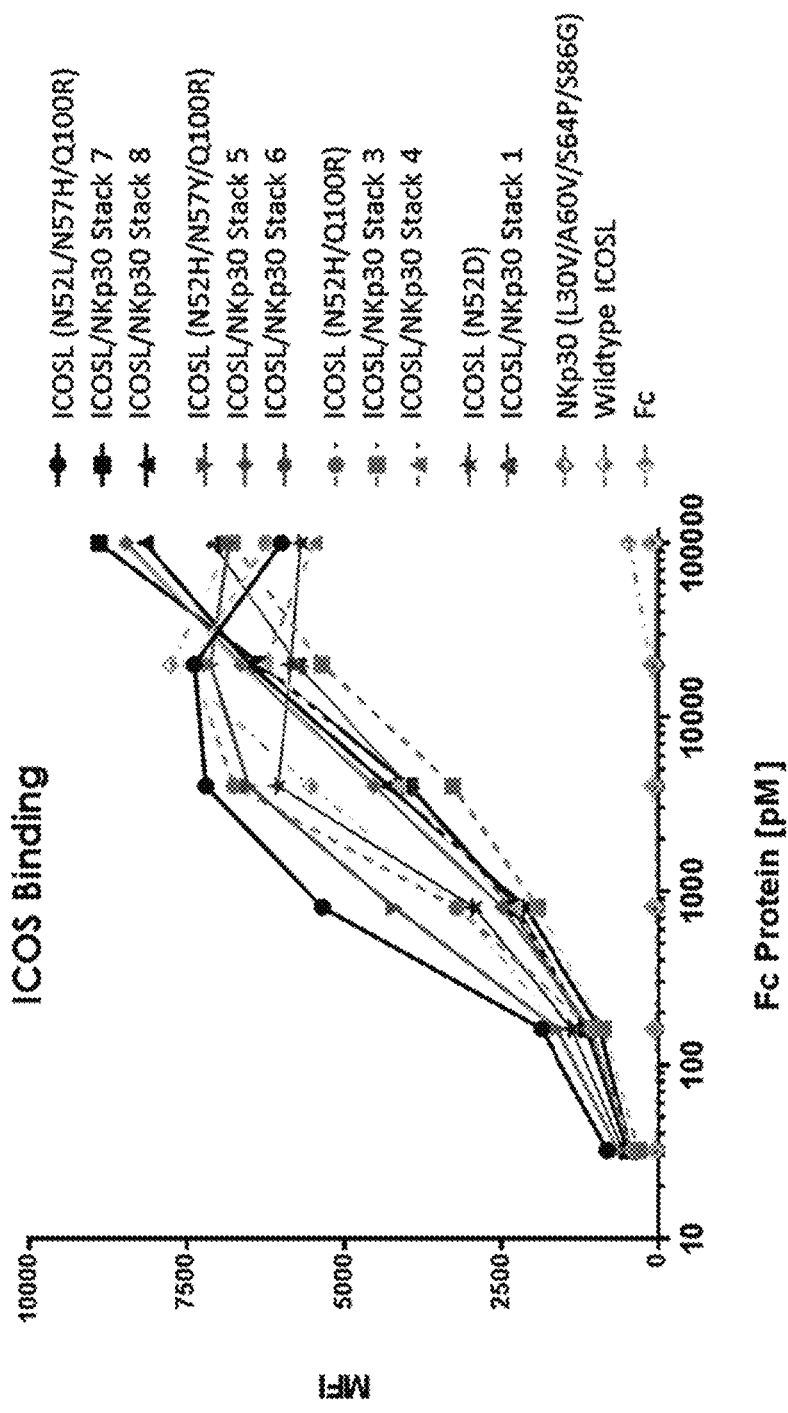
Figure 25C:
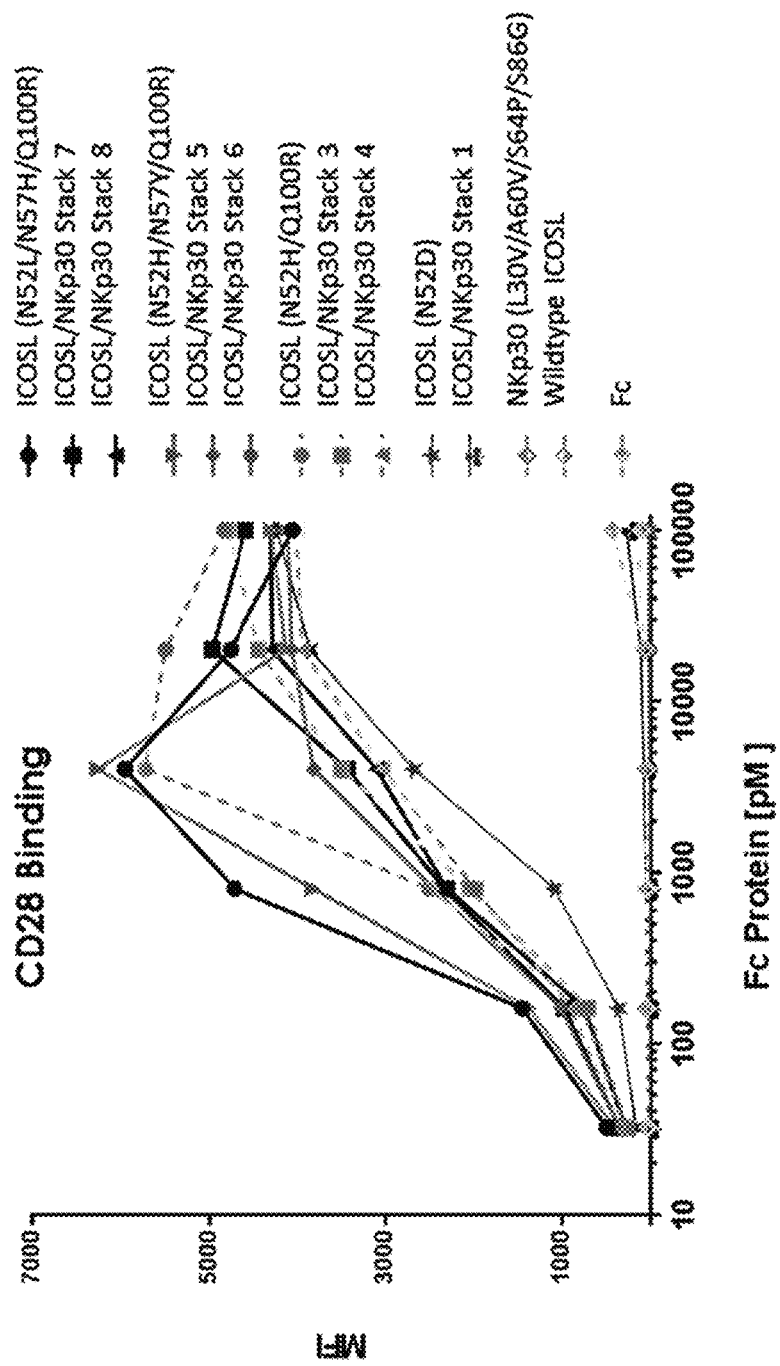
Figure 25D:
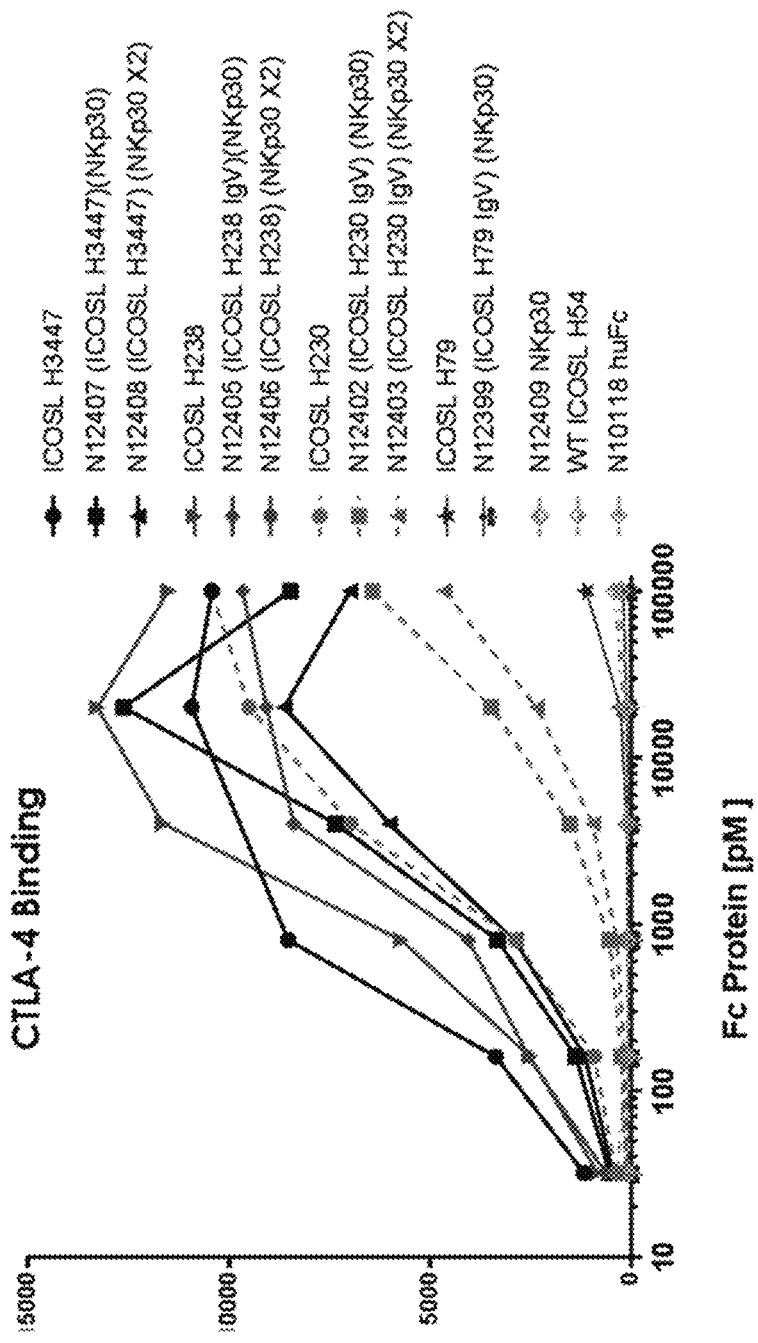

Assessment of Binding and Costimulatory Function of Fusion Molecules with HER2-Targeting Antibody An exemplary variant ICOSL ECD, containing mutations N52H/N57Y/Q100R was fused to either the N- or C-terminal ends of the heavy or light chain of the exemplary anti-HER2 antibody, trastuzumab, as depicted in the various configurations shown in FIGS. 24A-24F. VmAbs DNA encoding each of the constructs diagrammed in FIGS. 24A-24F was transfected into HEK-293 cells and secreted proteins were purified by Protein A and size exclusion chromatography. The resultant V-mAb proteins were next assessed for retention of appropriate binding properties. HEK-293 cells were transiently transfected with HER2, CD28, or ICOS expression vectors and each transfectant was then incubated with individual V-mAb proteins plus a secondary antibody for detection of bound reagents. As shown in FIG. 24A, HER2 binding was retained by all V-mAbs although the magnitude of the binding was reduced somewhat. Moreover, binding of V-mAbs to CD28 transfected cells was largely intact, although a few forms showed some reduction in binding (FIG. 24A). This data indicated that the ICOSL variants fused to antibody heavy and/or light chains to form fusion proteins largely retained counter-structure and antibody binding activity.

To test whether VmAbs could drive target-specific costimulation of T cells, a transfected cell system including a T cell reporter line for measuring costimulation was used. Jurkat cells with an IL-2 promoter luciferase reporter were used to evaluate costimulatory function. To stimulate the cells, K562 cells were engineered for use as an artificial antigen presenting cell. Specifically, K562 cells were transduced with a lentivirus encoding a single-chain Fv version of the anti-CD3 antibody OKT3 with or without transduction with a separate lentivirus directing HER2 expression. K562 cells displaying cell surface anti-CD3 single chain Fv (OKT3) with or without surface HER2 expression were plated in Jurkat Assay Buffer (RPMI1640+5% FBS) at $2\times10^4$ cell/well. Target cells were incubated with V-mAbs titrated from 20,000 pM to 6 pM or control proteins for 20 minutes at room temperature. Jurkat effector cells expressing an IL-2-luciferase reporter gene (Promega) were added at $1\times10^5$ cell/well to bring the final volume/well to 100 µl. Target and Jurkat cells were incubated for 5 hours at 37° C. Plates were removed from the incubator and acclimated to room temperature for 15 minutes. 100 µL of cell lysis and luciferase substrate solution (BioGlo luciferase reagent, Promega) was added to each well and the plates were incubated on an orbital shaker for 10 minutes. Luminescence was measured with a 1 second per well integration time using a Cytation 3 imaging reader (BioTek Instruments). Relative luminescence values (RLU) were determined for each test sample and reported.

As shown in FIG. 24B, inclusion of native trastuzumab had no effect on luciferase induction. Similarly, inclusion of the variant ICOSL-Fc protein N52H/N57Y/Q100R (not fused to trastuzumab) did not affect responses (FIG. 24B). However, inclusion of multiple V-mAbs provided a significant costimulatory signal in the presence of HER2+ K562/OKT3 cells that was much more robust than with K562/OKT3 that lacked HER2 expression (FIGS. 24C-24F). In some cases, signal was induced in K562/OKT3 cells lacking HER2, but this was most likely due to the Fc domain of the V-mAbs allowing CD32-mediated presentation of the V-mAbs. The results indicate that fusing a variant ICOSL polypeptide to an antibody can be used to deliver a localized T cell costimulatory signal.

Example 31

Generation of Stacked Molecules Containing ICOSL and NKp30 Affinity-Modified Domains This Example describes immunomodulatory proteins that were generated as multi-domain stack constructs containing an affinity modified IgV domain from identified variant ICOSL polypeptides and identified variant NKp30 polypeptides described above. Specifically, an exemplary variant ICOSL IgV (N52D as set forth in SEQ ID NO:548; N52H/Q100R as set forth in SEQ ID NO:567; N52H/N57Y/Q100R as set forth in SEQ ID NO: 565; N52L/N57H/Q100R as set forth in SEQ ID NO: 761), and the exemplary variant NKp30 IgV molecule L30V/A60V/S64P/S86G (SEQ ID NO: 504) were linked together and fused to an inert Fc (containing mutations L234A, L235E and L235E in a human IgG1 Fc, e.g. set forth in SEQ ID NO:637) in various configurations. Homodimeric stack constructs were generated containing identical Fc subunits in which the variant ICOSL IgV and variant NKp30 IgV were variously linked to the N- or C-terminus of the Fc region via a GSGGGS (SEQ ID NO: 635) and/or 3×GGGGS (SEQ ID NO: 228) peptide linker. Other linkers and Fc regions also are suitable for generation of stack molecules. Exemplary generated stacks are set forth below.

Nucleic acid molecule encoding the immunomodulatory proteins also contained residues encoding the exemplary signal peptide MGSTAILALLLAVLQGVSA (set forth in SEQ ID NO: 225). Expression constructs encoding Fc fusion proteins of interest were transiently expressed in Expi293 HEK293 cells from Invitrogen using the manufacturer's commercial Expifectamine reagents and media. Supernatants were harvested and protein was captured and eluted from a Protein A column using an AKTA protein purification system.

The encoding nucleic acid molecule was designed to produce homodimeric stacks in various configurations of sequences in the order shown in Table 32.

TABLE 32

Description of ICOSL/NKp30 Immunomodulatory Proteins

| Stack | Protein SEQ ID NO (DNA SEQ ID NO) | Description |
|---|---|---|
| ICOSL/ NKp30 Stack 1 | 912 (911) | ICOSL variant (SEQ ID NO: 548)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 2 | 914 (913) | ICOSL variant (SEQ ID NO: 548)- 3x GGGGS (SEQ ID NO: 228)- NKp30 variant (SEQ ID NO: 504)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 3 | 916 (915) | ICOSL variant (SEQ ID NO: 567)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 4 | 918 (917) | ICOSL variant (SEQ ID NO: 567)- 3x GGGGS (SEQ ID NO: 228)- NKp30 variant (SEQ ID NO: 504)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 5 | 920 (919) | ICOSL variant (SEQ ID NO: 565)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 6 | 922 (921) | ICOSL variant (SEQ ID NO: 565)- 3x GGGGS (SEQ ID NO: 228)- NKp30 variant (SEQ ID NO: 504)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 7 | 924 (923) | ICOSL variant (SEQ ID NO: 761)- 3x GGGGS (SEQ ID NO: 228)- NKp30 variant (SEQ ID NO: 504)- GSGGGGS (SEQ ID NO: 635)-Fc (SEQ ID NO: 637) |
| ICOSL/ NKp30 Stack 8 | 926 (925) | ICOSL variant (SEQ ID NO: 761)- 3x GGGGS (SEQ ID NO: 228)- NKp30 variant (SEQ ID NO: 504)- 3x GGGGS (SEQ ID NO: 228)- NKp30 variant (SEQ ID NO: 504)- GSGGGGS (SEQ ID NO: 635)- Fc (SEQ ID NO: 637) |

Example 32

Assessment of Binding to Cell-Expressed Counter Structures and Bioactivity of ICOSL and NKp30 Domain-Containing Stack Molecules This Example describes binding studies to show specificity and affinity of exemplary ICOSL/NKp30 stack immunomodulatory proteins generated in Example 31 for cognate binding partners. The exemplary ICOSL/NKp30 stack immunomodulatory proteins generated in Example 31 also were assessed for bioactivity characterization in a human primary T cell in vitro assay.

A. Binding to Cell-Expressed Counter Structure

ICOSL/NKp30 stack binding studies were performed on cells with stable or transient cell surface expression of cognate binding partners specific for ICOSL domain variant immunomodulatory proteins or NKp30-Fc.

For assessing binding to a binding partner of variant ICOSL domains, Chinese hamster ovarian cells (CHO) were used which had been transduced with lentivirus for surface expression of full-length human CD28, CTLA-4, or ICOS.

To produce cells expressing the cognate binding partner of NKp30, a full-length mammalian surface expression construct containing human B7-H6 was cloned into a pcDNA3.1 expression vector (Life Technologies). Binding studies were carried out using the Expi293F transient transfection system (Life Technologies, USA). Briefly, for a 30 mL transfection, approximately 75 million Expi293F cells were incubated with 30 µg of expression construct DNA and 1.5 mL diluted ExpiFectamine 293 reagent for 48 hours, at which point cells were harvested for staining.

For flow cytometric analysis, 200,000 cells of a given stable cell line, transient transfection or appropriate negative control were plated in 96 well round bottom plates. Cells were spun down and suspended in staining buffer (PBS (phosphate buffered saline), 1% BSA (bovine serum albumin), and 0.1% sodium azide) for 20 minutes to block non-specific binding. Afterwards, cells were centrifuged again and suspended in staining buffer containing 100 nM to 32 pM of ICOSL/NKp30 stack or control protein in 50 µL. Primary staining was performed for 45 minutes, before washing cells in staining buffer twice. Bound protein was detected with PE-conjugated anti-human IgG (Jackson ImmunoResearch, USA) diluted 1:150 in 50 µL staining buffer and incubated for 30 minutes. After final incubation, cells were washed twice to remove unbound conjugated antibodies, fixed in 2% formaldehyde/PBS, and analyzed on a LSRII (Becton Dickinson, USA) flow cytometer. Mean Fluorescence Intensity (MFI) was calculated for each sample with FlowJo Version 10 software (FlowJo LLC, USA).

Binding activity as measured by MFI was assessed for all ICOSL-NKp30 Fc fusion proteins or controls. As shown in FIGS. 25A-25D, exemplary stack proteins bound cognate proteins of both ICOSL and NKp30 with high affinity.

B. Assessment of Bioactivity of Affinity-Matured IgSF Domain-Containing Molecules Soluble ICOSL/NKp30 stack protein bioactivity was tested in a co-culture with B7-H6+ cells for induction of cytokine production in primary human T cells. K562 cells which endogenously express B7-H6 were transduced with lentivirus to express cell surface anti-human CD3 single chain Fv (OKT3) yielding K562/OTK3 targets. Human primary T cells were co-cultured at an effector to target (E:T) ratio of 2.5 or 10:1 with ICOSL/Nkp30 stack or control proteins titrated from 100 nM to 49 pM in 200 µL final volume of Ex-Vivo 15 media. On day 3-5, the assay was terminated and the culture supernatants were tested using IL-2 and TNF-alpha ELISA MAX kits (Biolegend, USA). Optical density was measured on a BioTek Cytation Multimode Microplate Reader (BioTek Corp., USA) and quantitated against titrated rIL-2 and rTNF-alpha standards included in the ELISA kits.

Figure 26A:
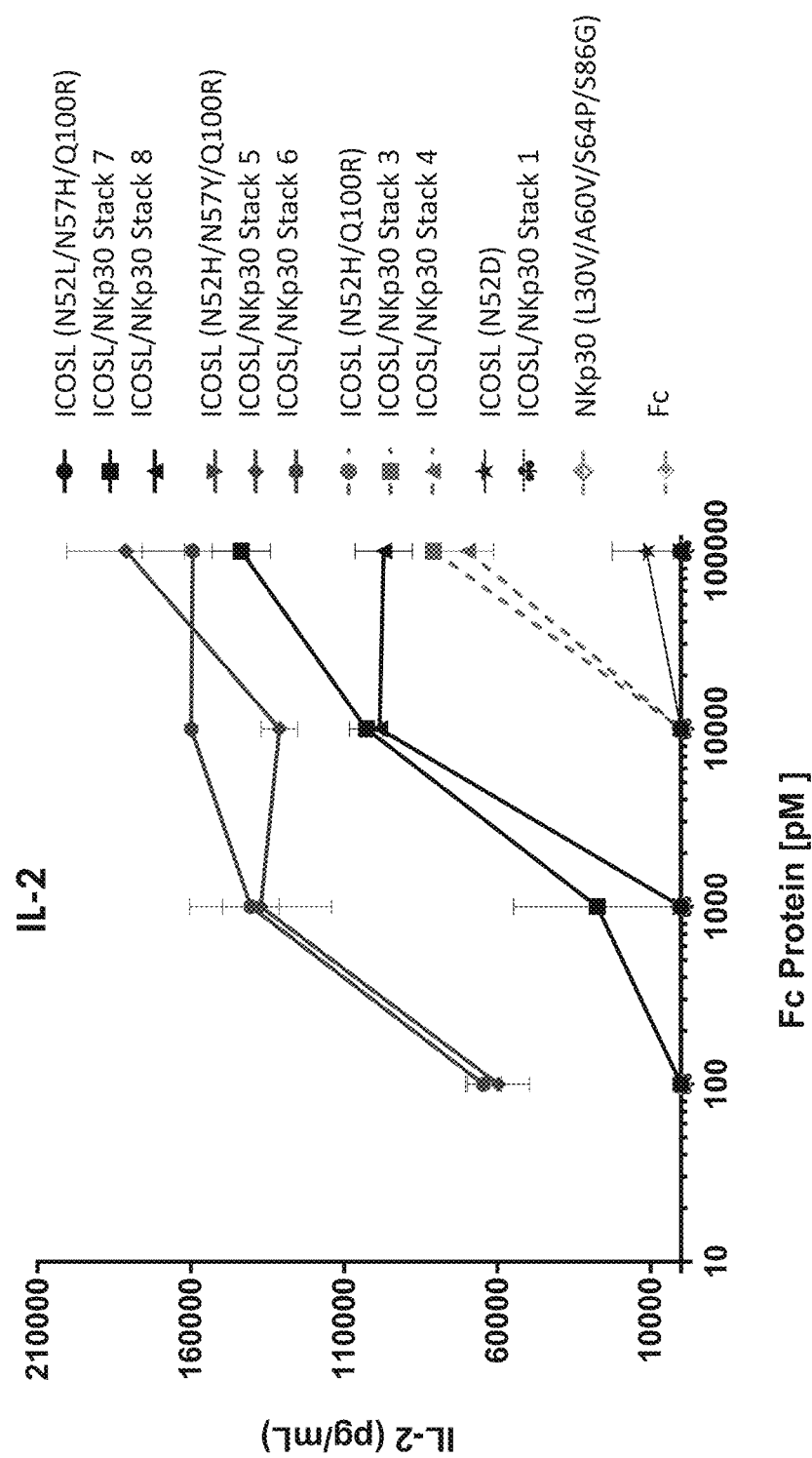
FIGS. 26A-26B depicts bioactivity studies for exemplary tested ICOSL/NKp30 stack proteins.
Figure 26B:
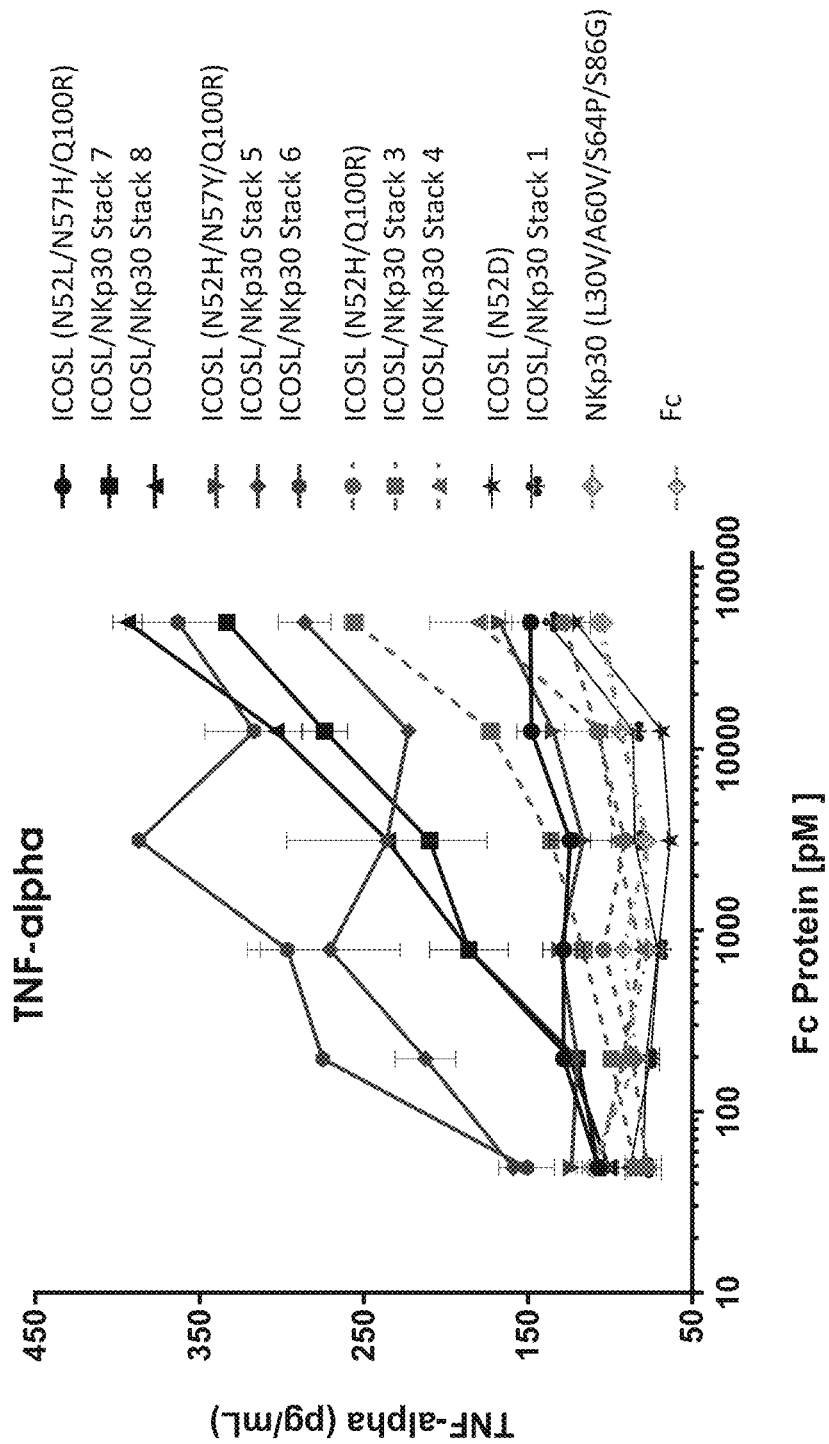

Results for the bioactivity studies for exemplary tested ICOSL/NKp30 stack proteins are shown in FIGS. 26A and 26B, which sets forth the calculated levels of IL-2 or IFN-gamma in culture supernatants (pg/mL). The sequence identifier (SEQ ID NO) for each stack proteins is set forth in in FIGS. 26A and 26B. Incubation in the presence of exemplary ICOSL/NKp30 stack proteins in this assay resulted in increased levels of B7-H6-dependent cytokine induction in primary human T cells demonstrated by an increase in cytokine production with the ICOSL/NKp30 stacks compared to the parental ICOSL or NKp30 only proteins.

C. Assessment of Proliferation

Proliferation of human T-cells co-cultured with ICOSL/NKp30 stack proteins and B7-H6+ cells was also characterized. CFSE-labeled human primary T-cells were stimulated for 3-5 days with K562/OKT3 at an E:T ratio of 2.5 to 10:1 in the presence of ICOSL/NKp30 stack proteins or control proteins. Exemplary ICOSL/NKp30 stack proteins were titrated from 100 nM to 49 pM in 200 μL final volume of Ex-Vivo 15 media. Proliferation was measured by flow cytometric analysis of CFSE-dilution on CD4+ or CD8+ stained T-cells using LSRII flow cytometer and Flowjo software as described above.

Figure 27:
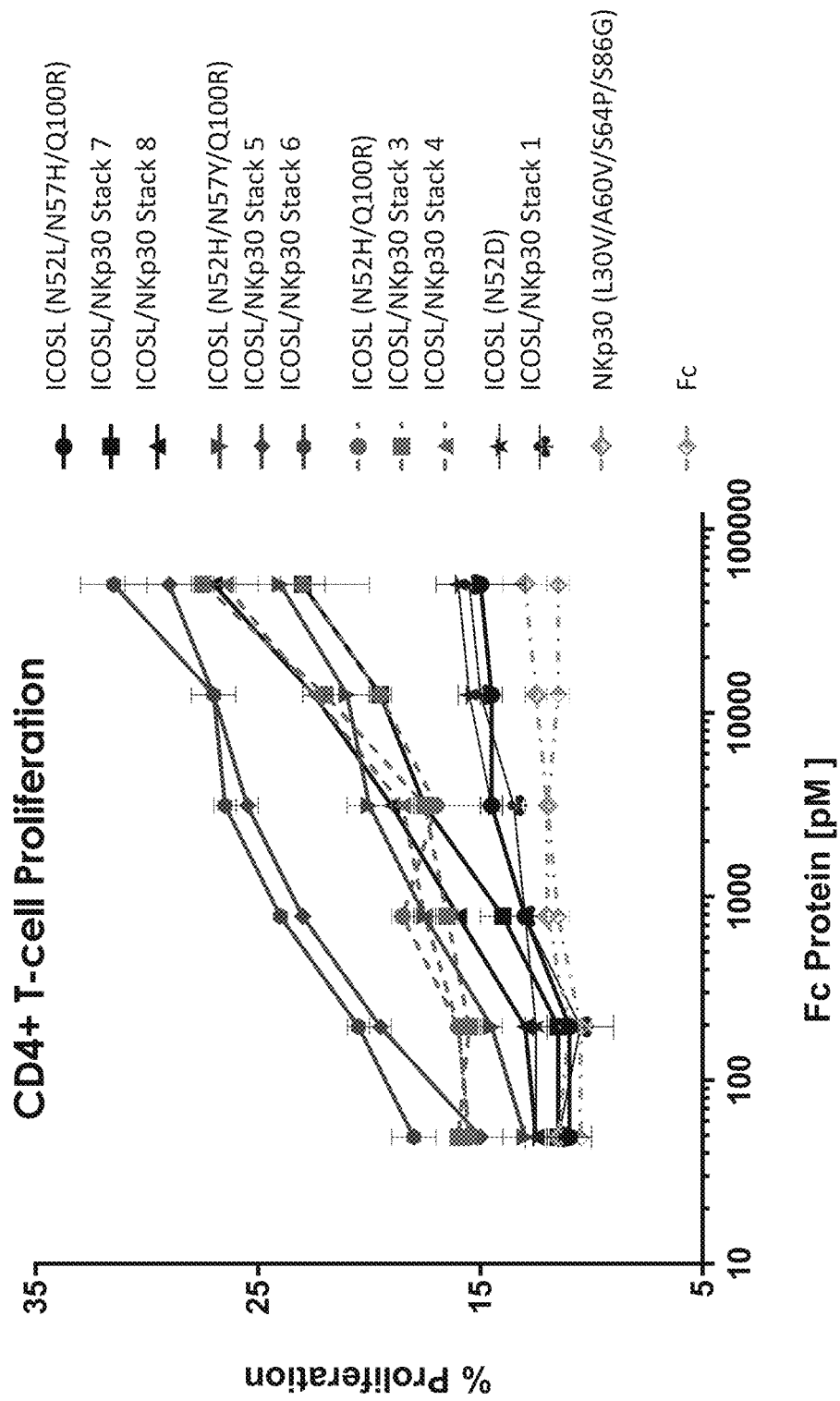
FIG. 27 depicts proliferation induced by ICOSL/NKp30 stack proteins as measured by flow cytometric analysis of CFSE-dilution on CD4+ or CD8+ stained T-cells.

As shown in in FIG. 27, exemplary tested ICOSL/NKp30 stack proteins costimulated proliferation of primary human CD4+ T cells in a B7H6-dependent manner demonstrated by an increase in proliferation of the ICOSL/NKp30 stack compared to the parental ICOSL or NKp30 only proteins.

Example 33

Assessment of ICOSL and NKp30 Domain-Containing Stack Molecules in Combination and Anti-PD-1 Antibody in Tumor Model This Example describes the assessment of anti-tumor activity of an exemplary ICOSL/NKp30 stack proteins, generated as described in Example 31, evaluated alone or in combination with an anti-mouse PD-1 monoclonal antibody (mPD-1 mAb) in mice bearing B7-H6+ CT26 colon carcinoma cells.

Mice were implanted subcutaneously with approximately $0.3 \times 10^5$ B7-H6+ CT26 tumor cells. Tumors were grown to day 13 and mice were staged and measured for mean tumor volumes (80 to 120 mm$^3$). Tumors were measured with electronic calipers two-dimensionally beginning on day 6 post-tumor cell implant. Tumor volume was measured, and median tumor volume was determined. Three mice/group with smallest starting tumors (~75 mm$^3$) were excluded from the analysis.

Figure 28:
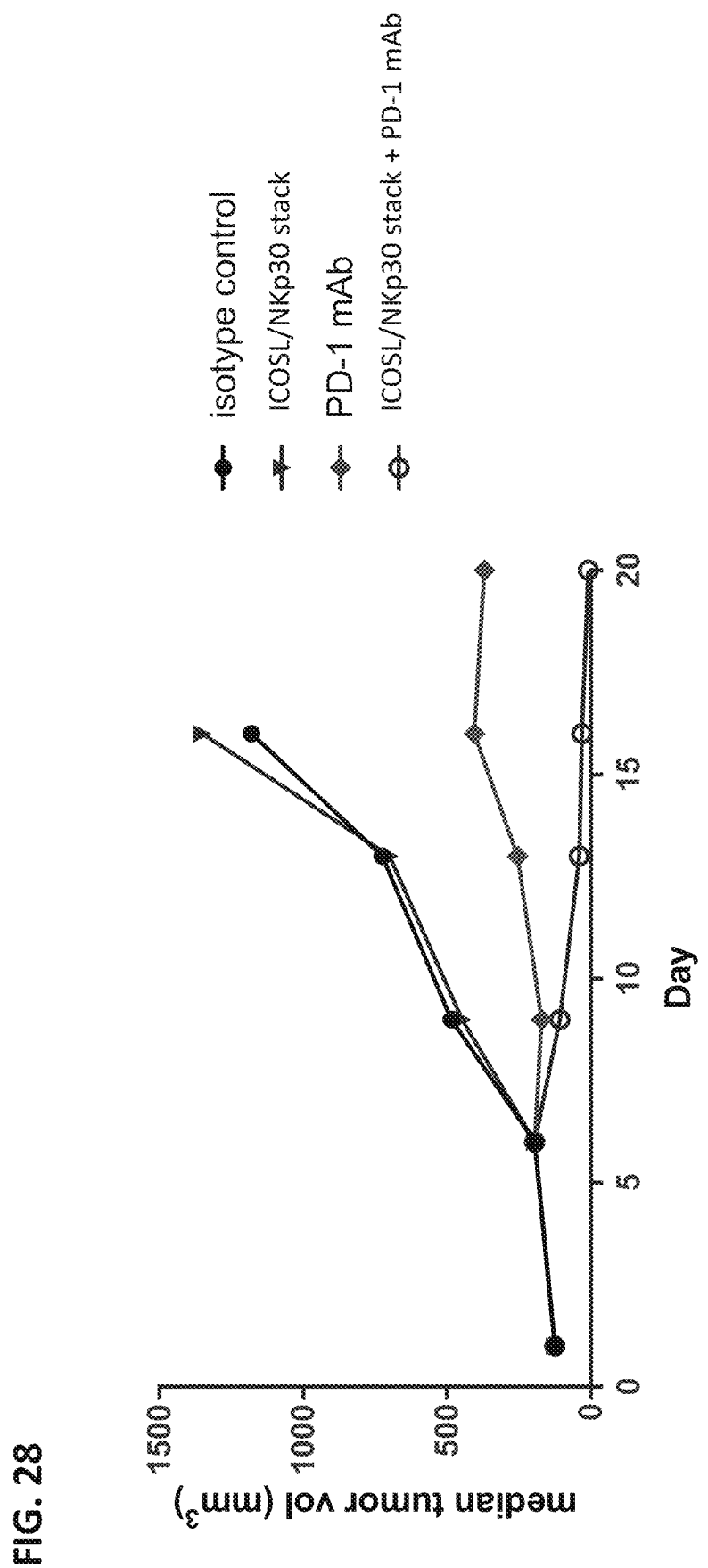
FIG. 28 depicts anti-tumor effects of the combination of the tested ICOSL/NKp30 stack protein and mPD-1 mAb.

As shown in FIG. 28, the combination of the tested ICOSL/NKp30 stack protein and mPD-1 mAb significantly reduced tumor growth (median tumor volumes) over time compared to groups treated with Fc control, either ICOSL or NKp30 alone, ICOSL/NKp30 stack alone, or anti-mouse PD-1 mAb alone. No differences in outgrowth of any treatment group with parental CT26 (B7-H6-negative) tumors was observed. The anti-tumor activity of the combination as shown in FIG. 28 is consistent with a finding that the combination of the tested ICOSL/NKp30 stack protein and anti-PD-1 antibody is better than individual reagents alone.

Example 34

Assessment of Dosing and In Vivo Effects of ICOSL IgV-Fc Fusion Molecules in a CIA Model Variant ICOSL IgV-Fc fusion molecules were assessed for anti-inflammatory activity in the collagen-induced arthritis (CIA) model with either prophylactic or therapeutic dosing. The variant ICOSL IgV-Fc fusion molecule was dosed a maximum of 4 times either prior to or just after disease onset. The tested variant ICOSL IgV-Fc fusion molecule contained a variant ICOSL IgV with N52H/N57Y/Q100P as set forth in SEQ ID NO: 570 or N52H/N57Y/Q100R as set forth in SEQ ID NO: 565, fused to an inert Fc (containing mutations L234A, L235E and L235E in a human IgG1 Fc, e.g. set forth in SEQ ID NO:637).

Figure 29A:
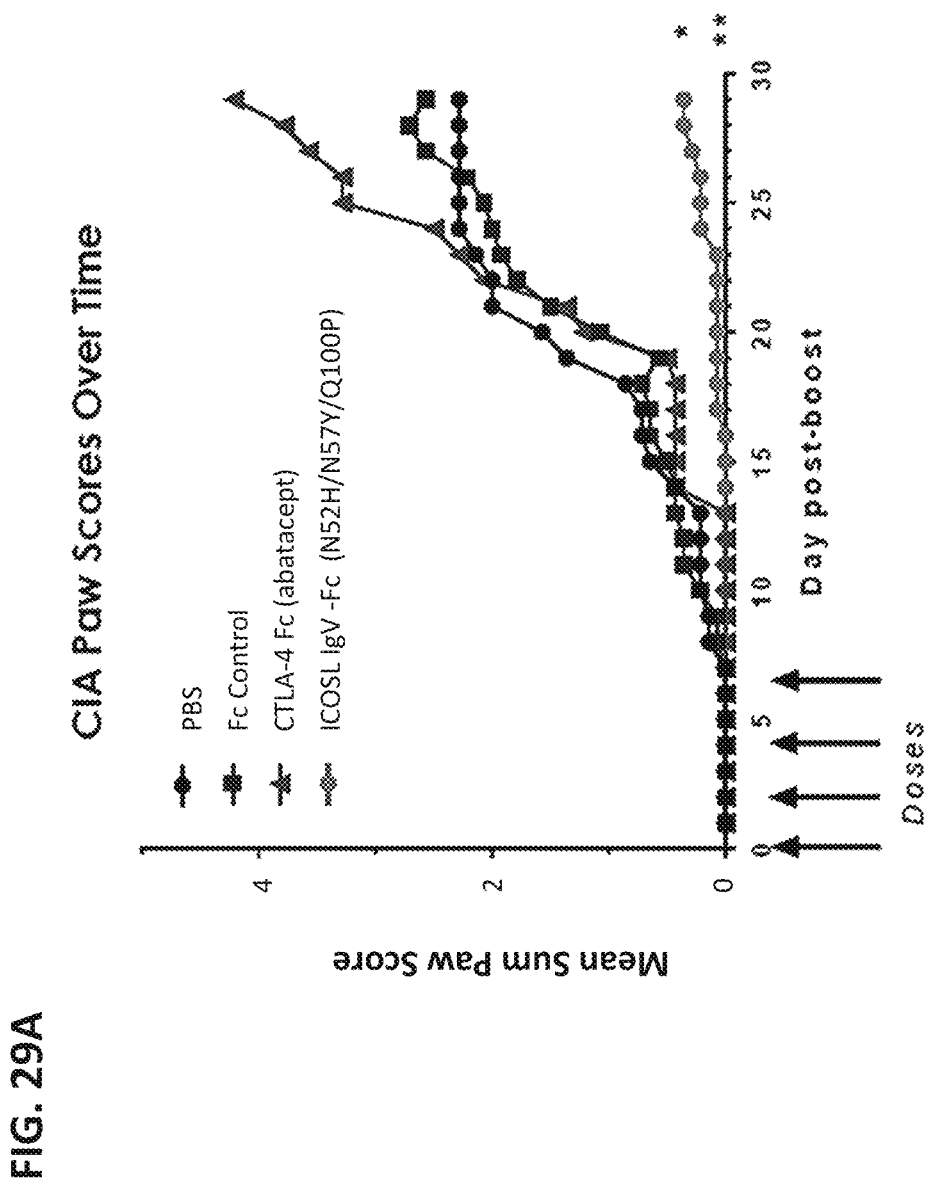
FIGS. 29A-29E depicts anti-inflammatory activity of prophylactic dosing of the exemplary ICOSL IgV-Fc fusion molecule in the collagen-induced arthritis (CIA) model, including mean sum paw score (FIG. 29A), detected CII IgG (FIG. 29B), serum cytokine levels (FIG. 29C), CD44+ activated T cells or $T_{FH}$ cells (FIG. 29D), and fraction of B cells in the draining lymph node (FIG. 29E).
Figure 29B:
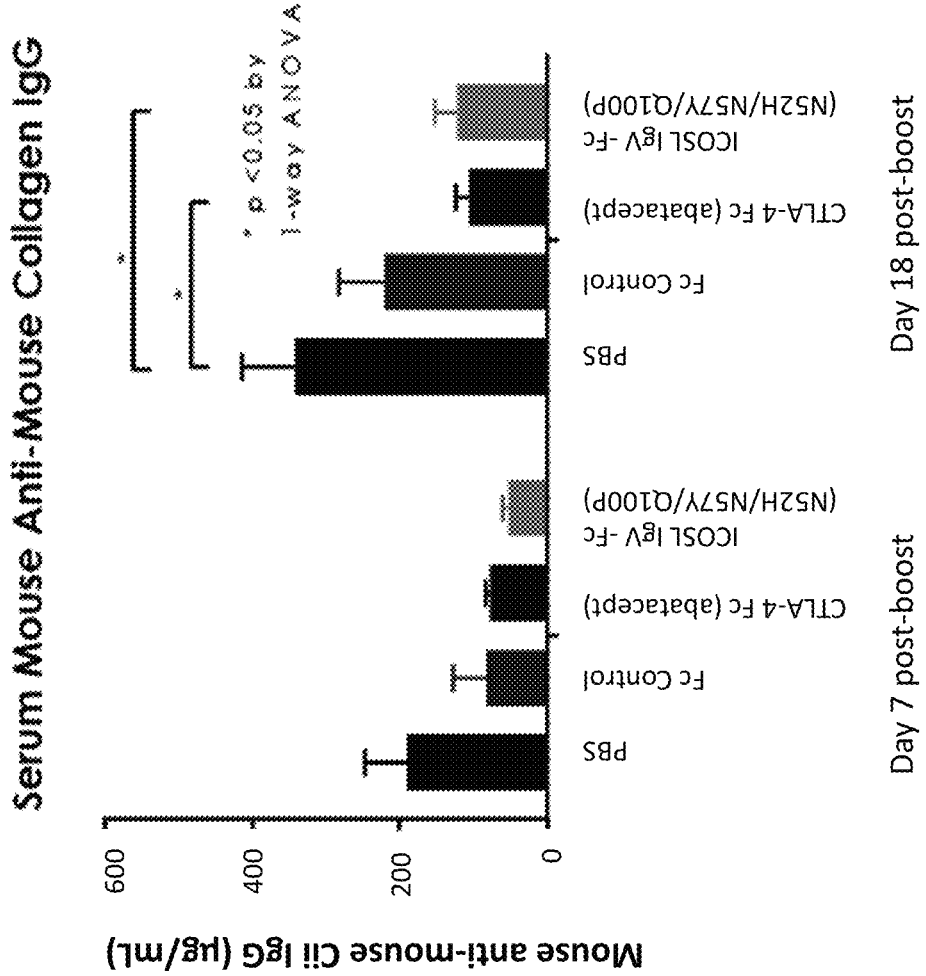
Figure 29C:
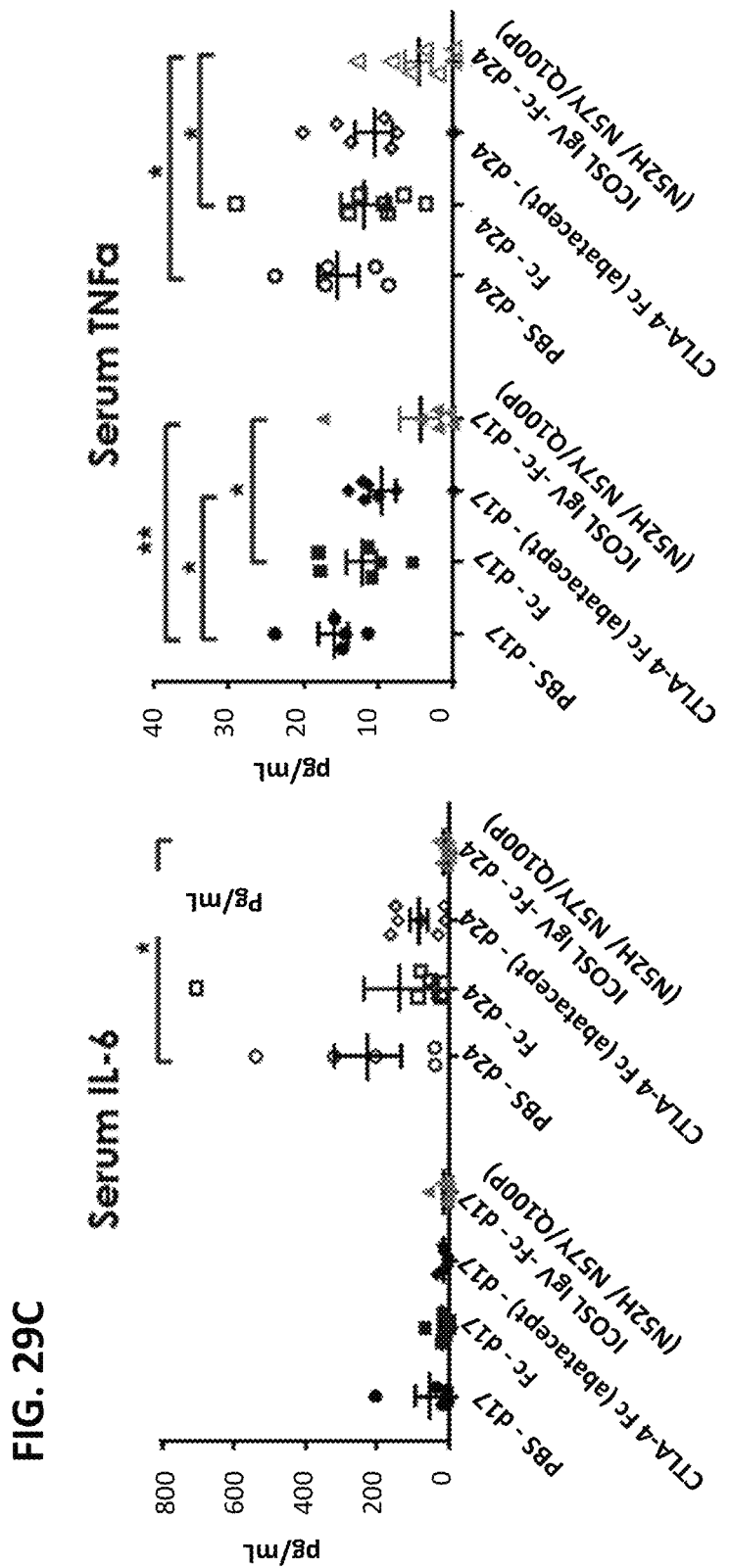
Figure 29D:
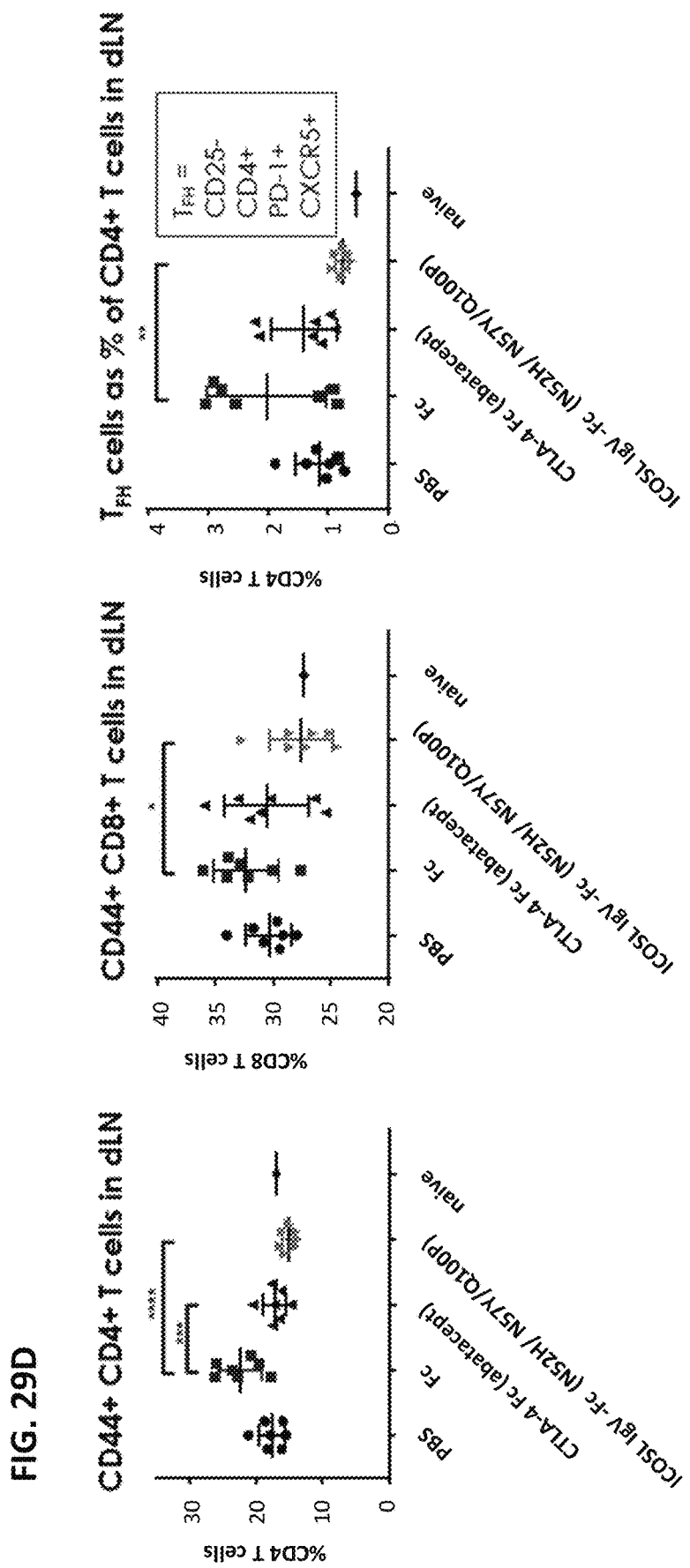
Figure 29E:
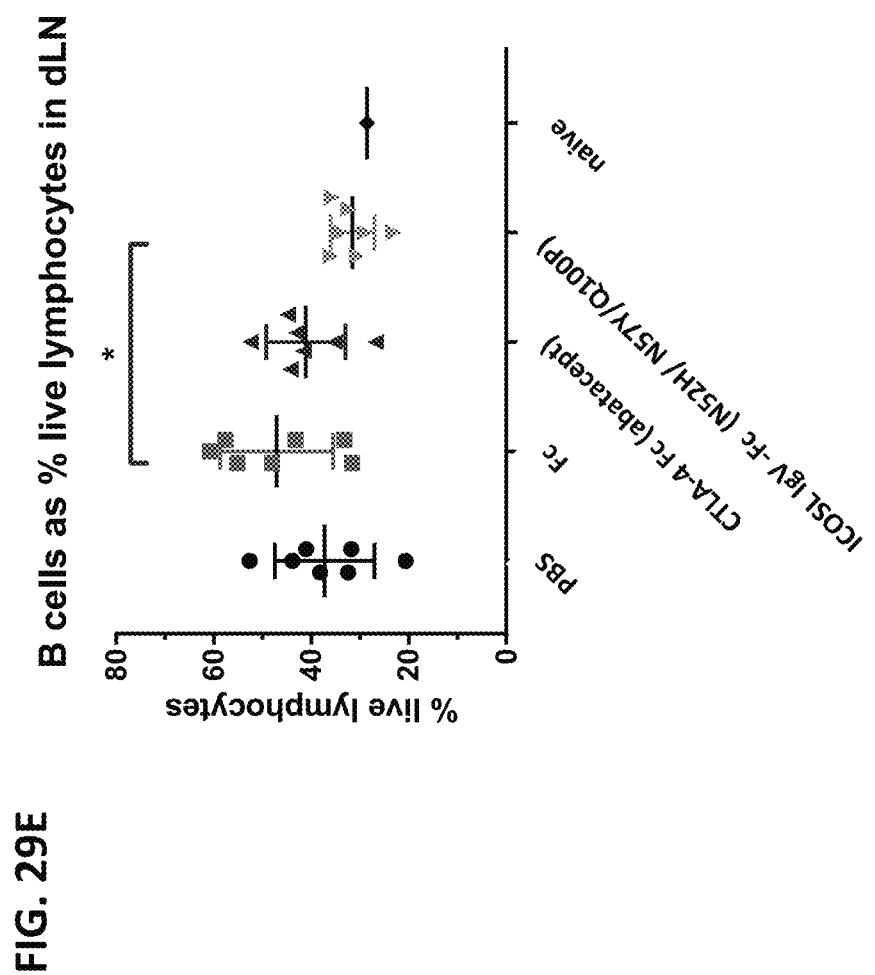

For induction of joint inflammation, mice were injected on day −18 or −21 with a chick or bovine collagen II/CFA emulsion in the tail and with a chick or bovine collagen II/IFA emulsion ('boost') on day 0. For prophylactic dosing, mice were dosed with the variant ICOSL IgV-Fc fusion molecule (N52H/N57Y/Q100P) with four doses beginning on the day of the boost, before the onset of disease. For therapeutic/delayed treatment, mice were dosed with the variant ICOSL IgV-Fc fusion molecule (N52H/N57Y/Q100R) started when the observed paw score was greater than one, and dosing occurred every two days for a total of four doses. As a control, Fc only molecules and a CTLA-4-Fc (abatacept) molecule were also tested. Paw score based on redness or swelling was determined. Serum also was collected to measure anti-collagen (CII IgG) antibodies and IL-6 and TNFα proinflammatory cytokines. Cells from draining lymph nodes were collected, stained for CD4, CD8, CD44 or markers of T follicular helper ($T_{FH}$) cells (CD25-CD4+PD-1+CXCR5+). FIGS. 29A-29D show results for prophylactic dosing. Mice treated with the variant ICOSL IgV-Fc fusion molecule on the prophylactic dosing treatment showed suppressed disease in the CIA mouse model of rheumatoid arthritis as shown by a lower mean sum paw score (FIG. 29A), and decreased detected CII IgG (FIG. 29B). *$p<0.05$ for ICOSL IgV-Fc vs. abatacept **$p<0.001$ for ICOSL IgV-Fc vs. PBS (by 2-way repeated-measures ANOVA). Lower levels of serum cytokines (FIG. 29C) and CD44+ activated T cells or $T_{FH}$ cells (FIG. 29D) were also observed in mice treated with the variant ICOSL IgV-Fc fusion molecule compared to Fc control; *$p<0.05$, $p<0.01$, *$p<0.001$, ****$p<0.0001$ (by 1-way ANOVA). The fraction of B cells in the draining lymph node was also significantly reduced in the ICOSL IgV-Fc treated group vs. the Fc control group ($p<0.05$) (FIG. 29E).

Figure 30C:
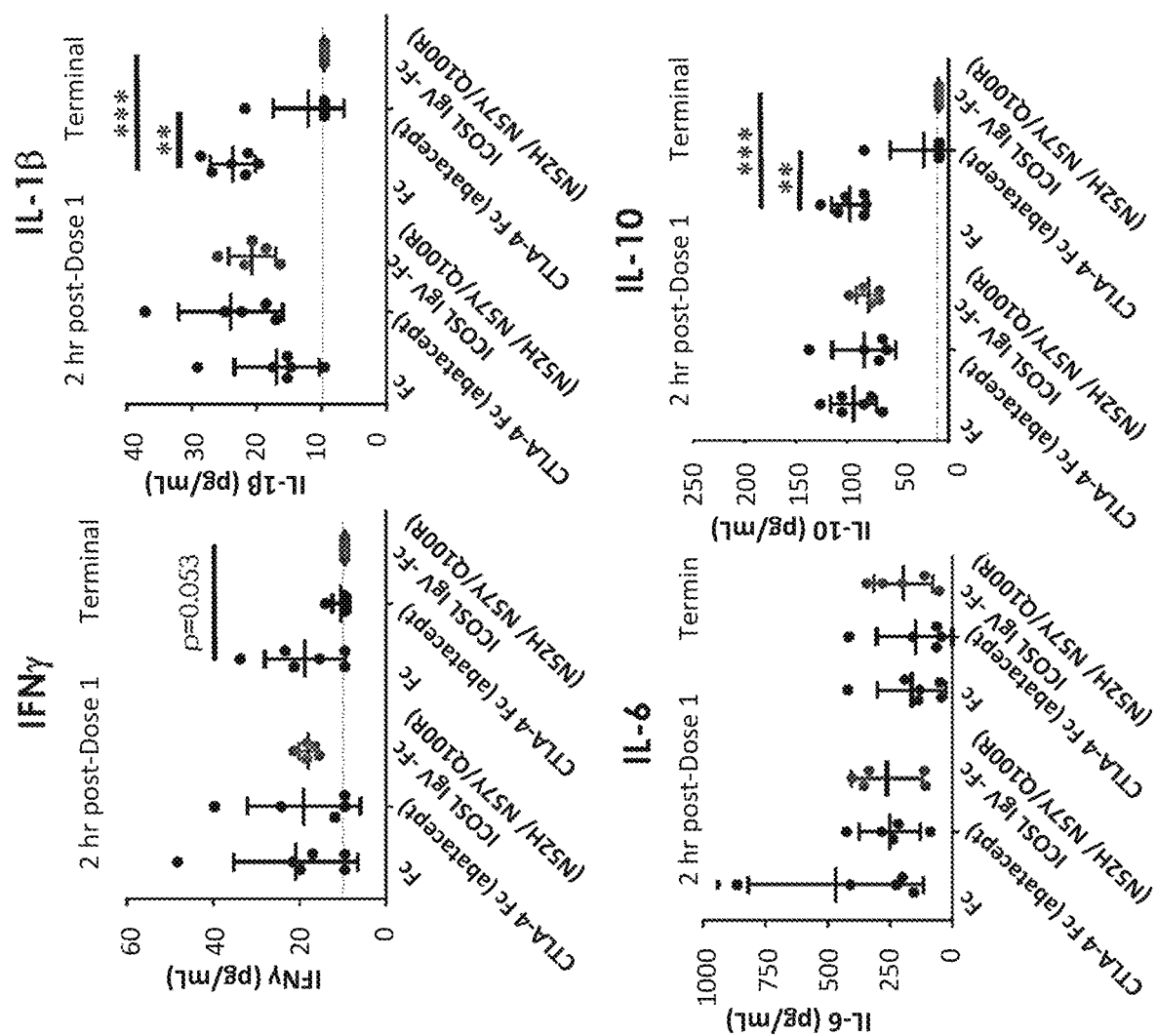
Figure 30D:
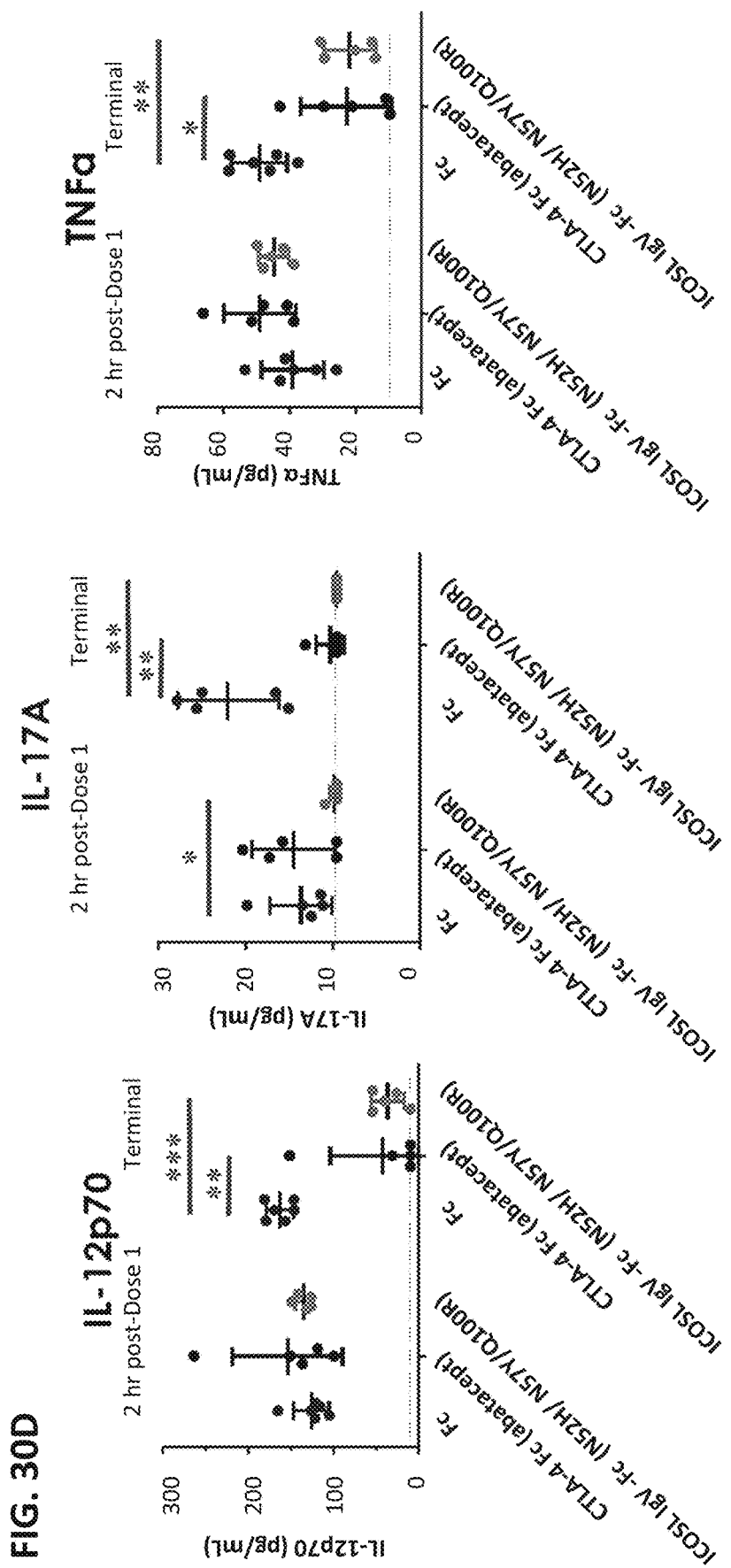

FIGS. 30A-30D show results for delayed dosing. The variant ICOSL-IgV Fc resulted in the lowest mean sum paw score (FIG. 30A) and greatest percent change in body weight (FIG. 30B) compared to other groups, including the abatacept control. As shown in FIG. 30C and FIG. 30D, serum cytokines also were suppressed in the therapeutic CIA model in mice treated with the variant ICOS IgV-Fc. Statistical significance between groups: *$p<0.05$; $p<0.01$; *$p<0.001$ by Student's unpaired t-test. In FIG. 30C and FIG. 30D, the dotted horizontal lines indicate the assay lower limit of quantification (LLOQ) for each cytokine.

Together, these data evidence that the CD28 and ICOS pathways play important roles in inflammatory arthritis. In particular, the superior activity of the variant ICOSL dual CD28/ICOS antagonist is consistent with an observation that blockade of both pathways is necessary and that only partial benefit is achieved by a single pathway blockade.

Example 35

Assessment of In Vivo Effects of ICOSL IgV-Fc Fusion Molecules in a EAE Model

A variant ICOSL IgV-Fc fusion molecule was assessed for anti-inflammatory activity in an adoptive transfer experimental autoimmune encephalomyelitis (EAE) model. The tested variant ICOSL IgV-Fc fusion molecule containing a variant ICOSL IgV (N52H/N57Y/Q100R; SEQ ID NO: 565) fused to an inert Fc (containing mutations L234A, L235E and L235E in a human IgG1 Fc).

Female C57BL/6 mice were subcutaneously injected with a MOG$_{35-55}$/CFA emulsion. After 11 days, spleen cells were obtained and cultured with MOG$_{35-55}$ peptide, IL-12, and anti-IFNγ. Three days post culture, encephalitogenic T cells were delivered via intraperitoneal injection (Day 0). Mice were dosed with variant ICOSL IgV-Fc fusion molecule every other day starting on Day 0 for a total of five doses. As a control, Fc only molecules and a CTLA-4-Fc molecule (abatacept) were also tested. For 20 days post injection of the T cells, mice were weighed, monitored and assessed for EAE score as described in Table 33. At end of study, serum was collected for analysis of pro-inflammatory cytokines, and cells from draining lymph nodes were collected for flow cytometric analysis.

TABLE 33

EAE Scoring

| Score | Clinical Observations |
|---|---|
| 0 | No obvious changes in motor functions |
| 1 | Limp tail |
| 2 | Limp tail and weakness of hind legs |
| 3 | Limp tail and complete paralysis of hind legs, OR Limp tail with paralysis of one front and one hind leg, OR ALL of: 1) Severe head tilting, 2) Walking only along the edges of the cage, 3) Pushing against the cage wall, 4) Spinning when picked up by the tail. |
| 4 | Limp tail, complete hind leg and partial front leg paralysis |
| 5 | Complete hind and complete front leg paralysis, no movement; OR Mouse is spontaneously rolling in the cage; OR Mouse found dead due to paralysis. |

Figure 31A:
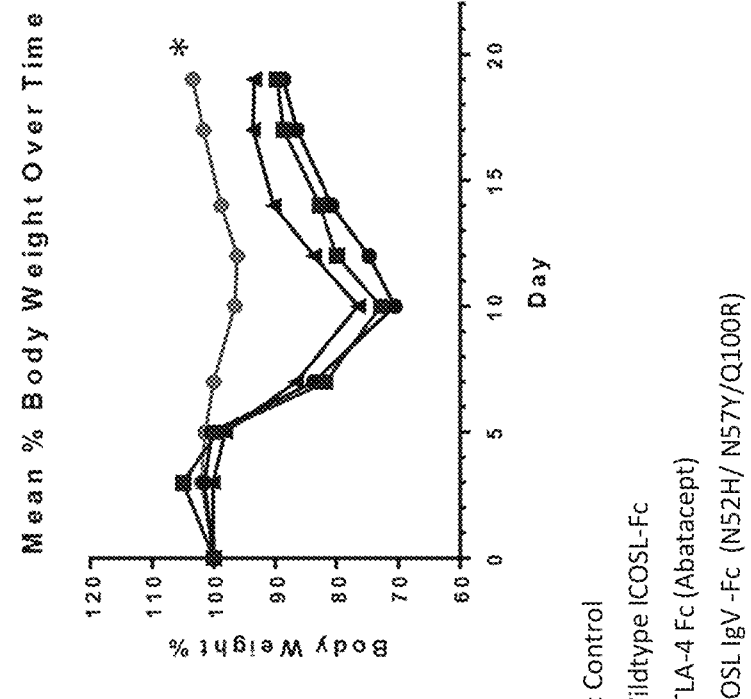
FIGS. 31A-31D depicts anti-inflammatory activity of delayed dosing of the exemplary ICOSL IgV-Fc fusion molecule in the experimental autoimmune encephalomyelitis (EAE) model, including EAE score (FIG. 31A), flow cytometric analysis of inguinal lymph node T cells (FIG. 31C), and proinflammatory cytokines (FIG. 31D).
Figure 31B:
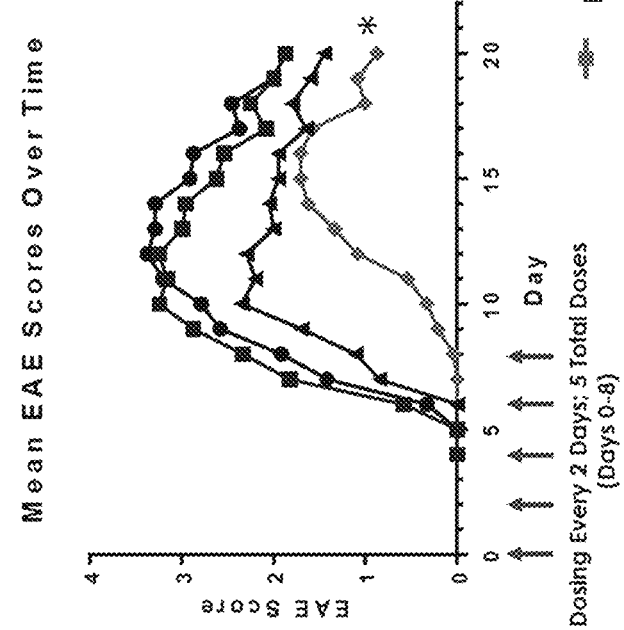

As shown in FIG. 31A, mice treated with the variant ICOSL IgV-Fc fusion molecule suppressed disease in the EAE mouse model as shown by a lower EAE score, *p<0.0001 by 1-way ANOVA Area Under the Curve (AUC); variant ICOSL IgV-Fc fusion molecule compared to controls.

Figure 31C:
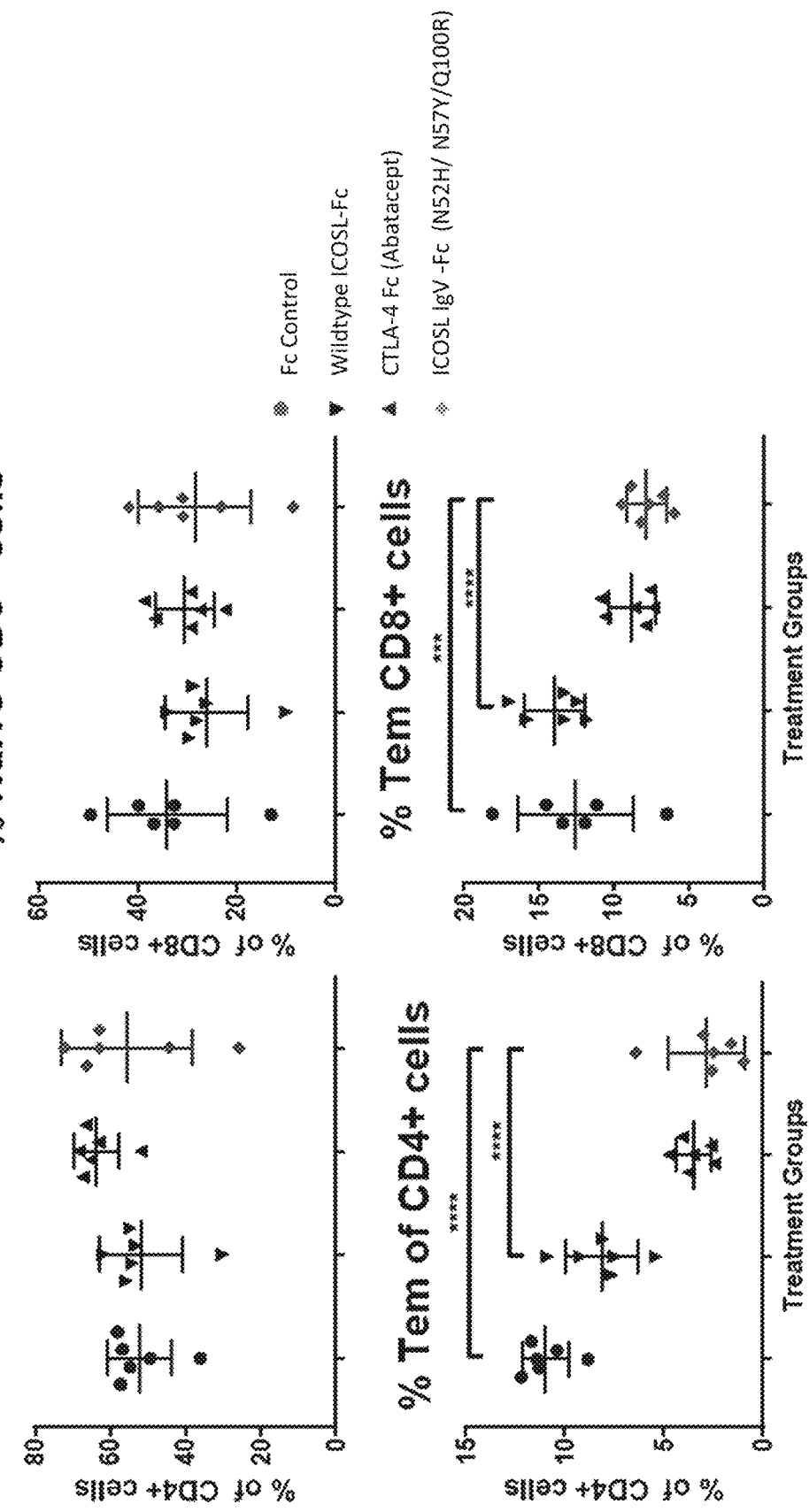

For flow cytometric analysis of inguinal lymph node T cells, the cells were stained with viability dye & analyzed with anti-CD44, anti-CD62L, anti-CD4, anti-CD8 and assessed for percentage of viable naïve (CD62L+CD44−) and T$_{effector}$ memory (Tem) (CD62L− CD44+) CD4+ and CD8+ T cells. As shown in FIG. 31C, CD4+ and CD8+ Tem cells were reduced with treatment with the variant ICOSL IgV-Fc fusion molecule (**p<0.0001; *p<0.001 by 1-way ANOVA).

Figure 31D:
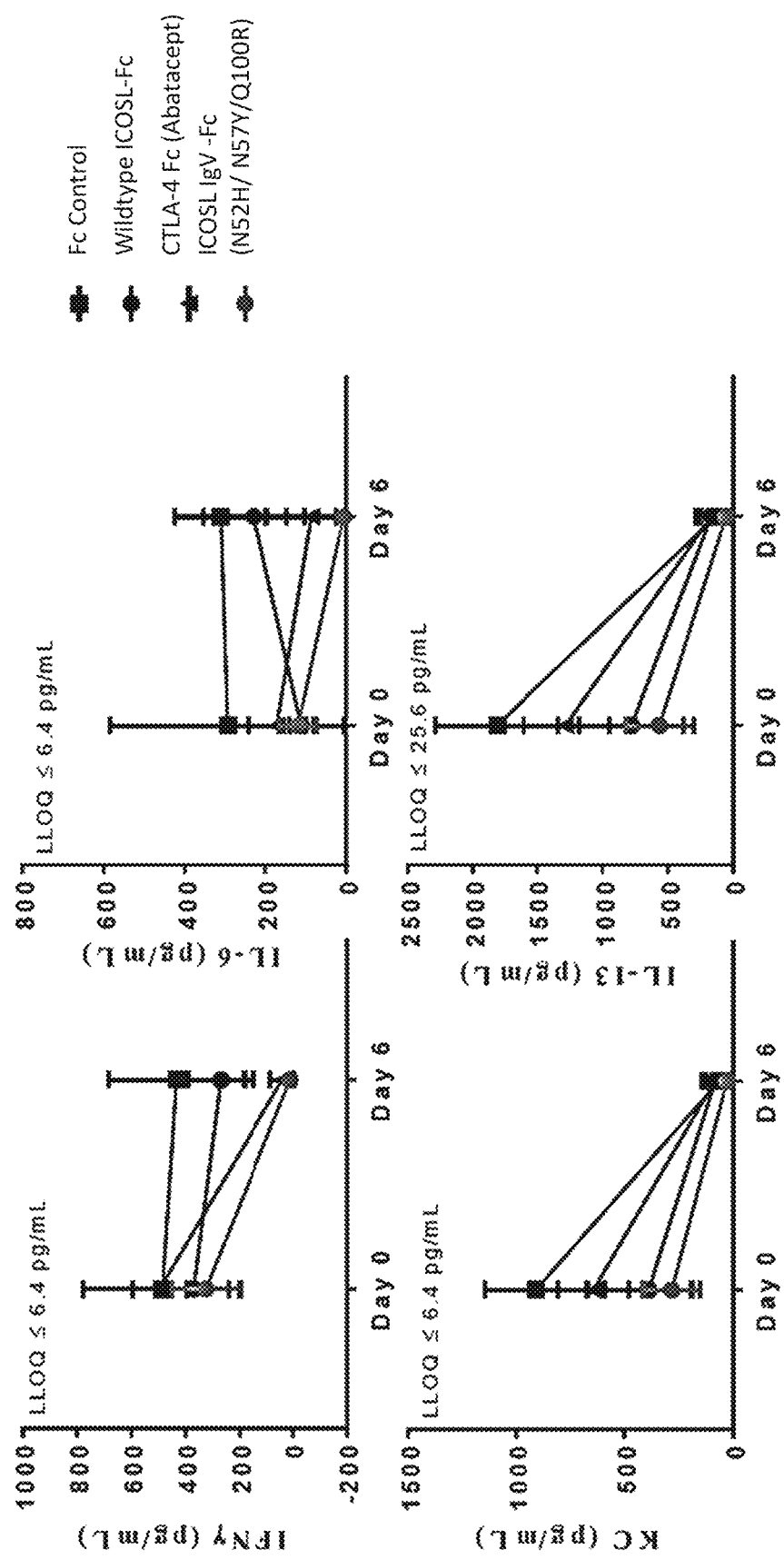

Serum cytokines were assessed on Day 0 (2 hours post 1$^{st}$ dose) and on Day 6 (1 hour before 4$^{th}$ dose). As shown in FIG. 31D, the tested variant ICOSL IgV-Fc fusion molecule resulted in reduction of pro-inflammatory cytokines in serum on Day 0, including IL-5, IL-10, IL-12p70 and TNFα. At day 6, serum levels of IFN-gamma and IL-6 were reduced by treatment with the variant ICOSL IgV-Fc fusion molecule compared to Fc control.

Example 36

Dose Ranging Study of Variant ICOSL-IgV Fc in Graft-Versus-Host-Disease (GvHD) Model A dose ranging study was conducted with 20, 100, or 500 μg of a variant ICOSL IgV-Fc molecule, containing a variant ICOSL IgV (N52H/N57Y/Q100R; SEQ ID NO: 565) fused to an inert Fc (containing mutations L234A, L235E and L235E in a human IgG1 Fc, e.g. set forth in SEQ ID NO:637), in a mouse model of graft-versus-host-disease (GVHD). The activity of the variant ICOSL IgV-Fc molecule was compared to belatacept (CTLA-4-FcL104E/A29Y; U.S. Patent Application Publication Number US2016/0271218).

Female NSG mice (n=5 per group for Group 1, no treatment; n=10 per group for treatment Groups 2-7) were administered 10 mg of gamma globulin subcutaneously and then irradiated (100 cGy/rad) on Day −1. On Day 0 (within 24 hours post-irradiation), the mice in Groups 2-7 were dosed with test articles as set forth in Table 34, and then all mice received 1×10$^7$ human PBMCs injected IV via tail vein post-dosing.

A disease activity index (DAI) was determined by evaluating the mice three times a week during the study and scoring disease based on body weight loss, posture, activity, appearance of the fur and skin of the mice. After the study was terminated on Day 42, endpoint measurements of survival, body weight loss, and disease activity were evaluated. Kaplan-Meier survival plots representing the percentage of animals surviving to the study endpoint were generated and survival curve comparisons were analyzed by the Mantel-Cox and Gehan-Breslow-Wilcox tests (95% CI). Blood/serum samples were collected from surviving mice at the end of the study (Day 42) and cells were assessed by flow cytometry for markers of T cells, including mouse or human markers, CD4, CD8, CD28, ICOS, activation or exhaustion markers (PD-1, Ki67) and FoxP3 (a marker of Tregs). The levels of serum pro-inflammatory cytokines (e.g. IFN-gamma, IL-10, IL-12(p70), IL-17A, IL-4, IL-5 and TNFα) also were assessed.

TABLE 34

Dosing Schedule

| Group | N | Test Articles | Dose (μg) | Dose Volume (μl) | Route | Schedule | Start of Dosing |
|---|---|---|---|---|---|---|---|
| 1 | 5 | No treatment | n/a | n/a | n/a | n/a | n/a |
|   |   | Survival/DAI |   |   |   |   |   |
| 2 | 10 | Saline | n/a | 100 | IP | 3x weekly 4 weeks | Day 0 |
| 3 | 10 | variant ICOSL IgV-Fc | 500 | 100 | IP | 3x weekly 4 weeks | Day 0 |

TABLE 34-continued

Dosing Schedule

| Group | N | Test Articles | Dose (µg) | Dose Volume (µl) | Route | Schedule | Start of Dosing |
|---|---|---|---|---|---|---|---|
| 4 | 10 | variant ICOSL IgV-Fc | 100 | 100 | IP | 3x weekly 4 weeks | Day 0 |
| 5 | 10 | variant ICOSL IgV-Fc | 20 | 100 | IP | 3x weekly 4 weeks | Day 0 |
| 6 | 10 | Belatacept | 100 | 100 | IP | 3x weekly 4 weeks | Day 0 |
| PK/Survival//DAI | | | | | | | |
| 7 | 9 | variant ICOSL IgV-Fc | 100 | 100 | IP | Single Day 1 | Day 1 |

Figure 32A:
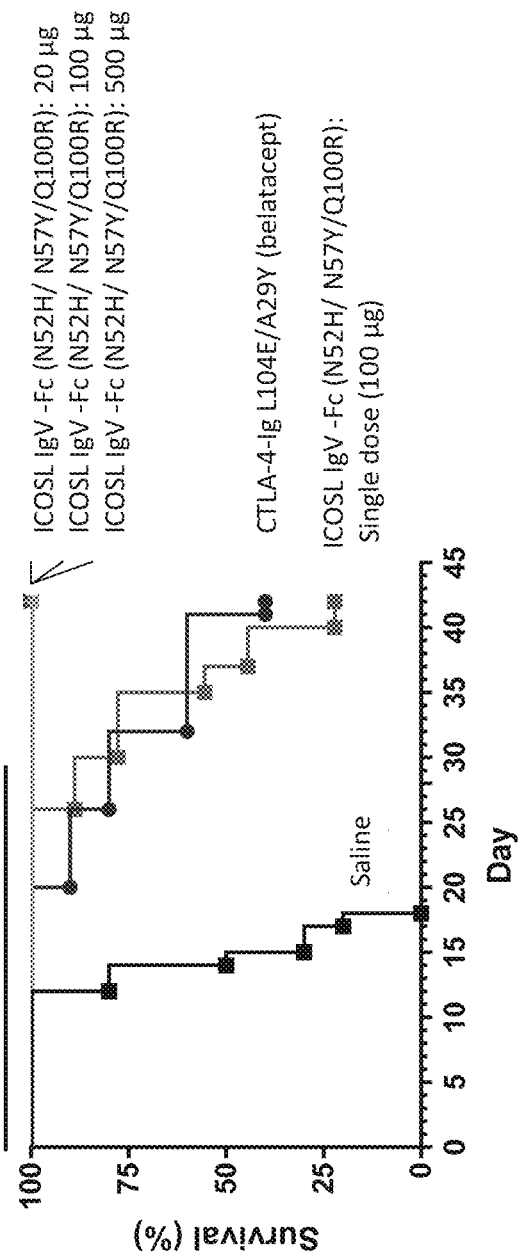
FIGS. 32A-32B depicts survival and DAI score of Graft-versus-Host-Disease (GvHD) mice treated with various doses (20, 100, or 500 µg) of a variant ICOSL IgV-Fc molecule.
Figure 32B:
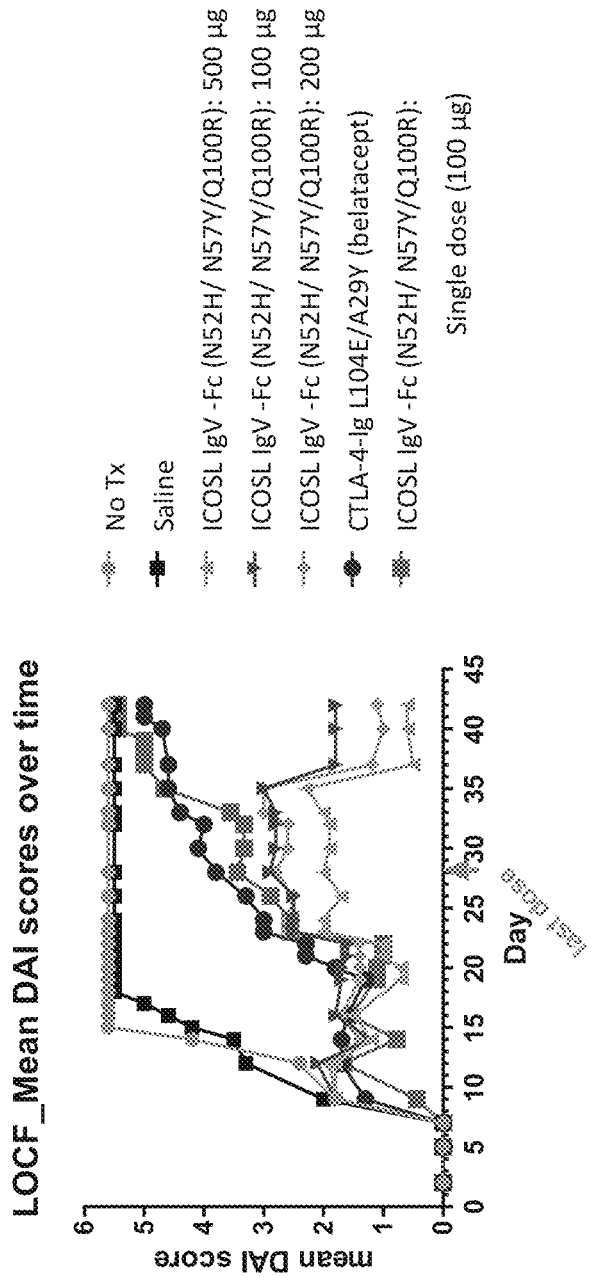

FIGS. 32A-32B show the survival and DAI scores of GVHD mice treated in accord with each dosing schedule. As shown, the tested variant ICOSL IgV-Fc (N52H/N57Y/Q100R) at all dose levels tested significantly enhanced survival (FIG. 32A) and reduced disease scores (FIG. 32B) compared to mice treated with belatacept (i.e. 100% vs. 40% survival at Day 42, respectively; $p<0.01$ by Mantel-Cox log rank test). Notably, single dose (100 µg) administration of variant ICOSL IgV-Fc (N52H/N57Y/Q100R) resulted in similar protection from disease as repeat dosing of 100 µg belatacept.

Figure 33A:
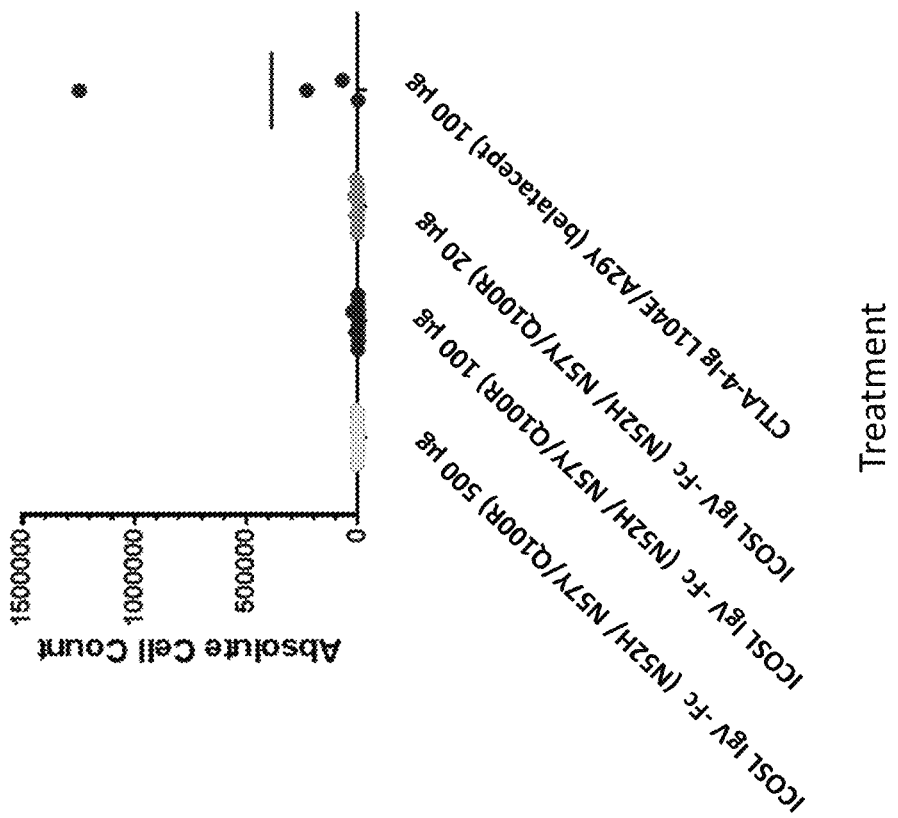
Figure 33B:
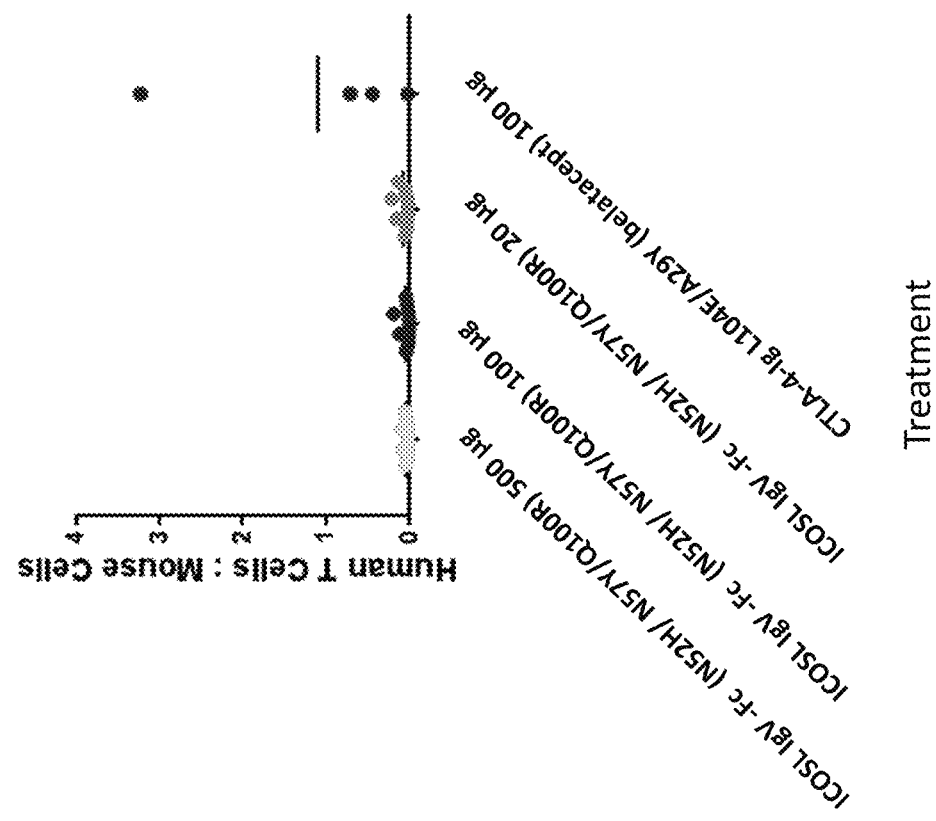
Figure 33C:
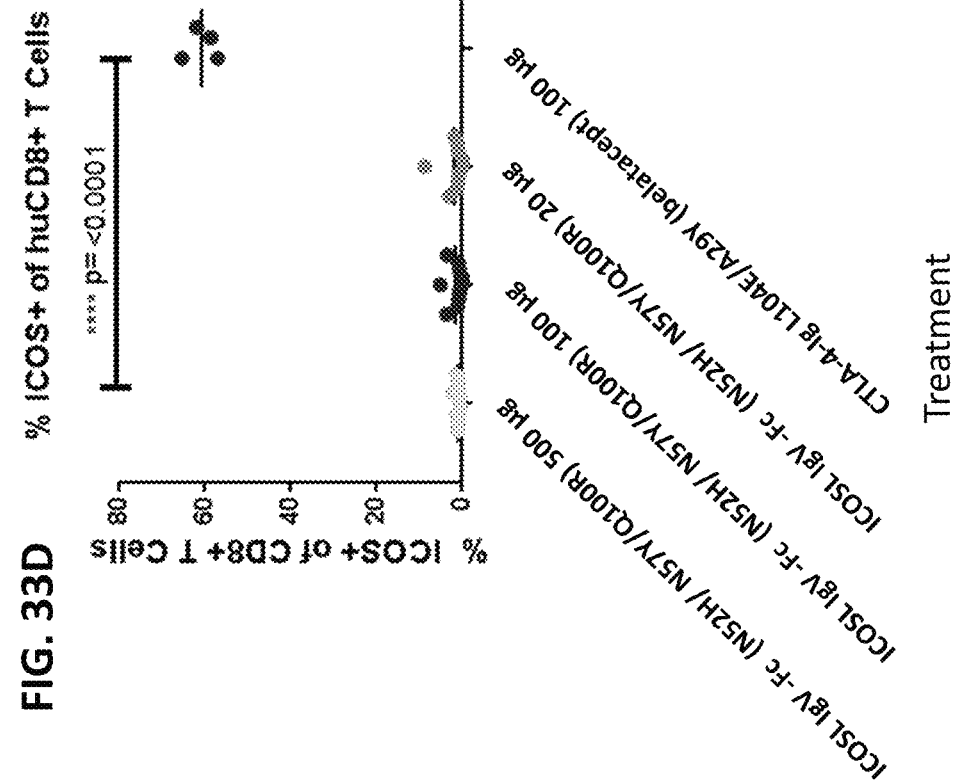
Figure 33D:
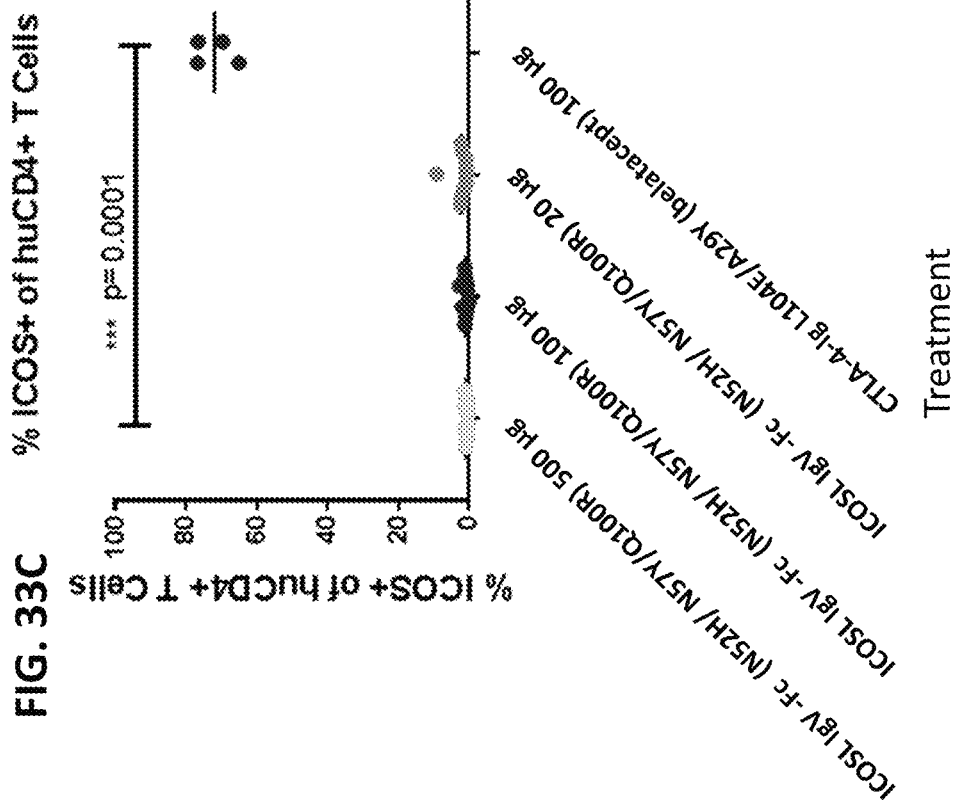

Flow cytometric analysis of blood collected at the end of the study demonstrated that the tested variant ICOSL IgV-Fc (N52H/N57Y/Q100R) effectively suppressed expansion of transferred human T cells as observed by a reduced ratio of human cells/mouse cells (FIG. 33A) and the greatly reduced total T cell counts (FIG. 33B). As shown in FIGS. 33C-33F, flow cytometry staining of blood collected at end of the study of CD4+ and CD8+ T cells co-stained for ICOS (FIGS. 33C-33D) and CD28 (FIGS. 33E-33F) demonstrated essentially no staining in groups treated with variant ICOSL IgV-Fc (N52H/N57Y/Q100R), although CD4+ and CD8+ T cells expressing ICOS were readily detectable in belatacept-treated mice. These results are consistent with the lack of T cells remaining in the ICOSL IgV-Fc-treated mice, and also with the ability of the variant ICOSL IgV-Fc (N52H/N57Y/Q100R) to bind its target molecules CD28 and ICOS and block their detection by the flow cytometry antibodies. Binding of variant ICOSL IgV-Fc (N52H/N57Y/Q100R) on the few remaining human T cells was confirmed by detection using anti-Human IgG Fc. Notably, while most of the transferred human T cells initially expressed CD28 and just 10-20% were ICOS+, the activated T cells remaining in the saline- or belatacept-treated mice at termination/end of study were >80% ICOS+.

Figure 34A:
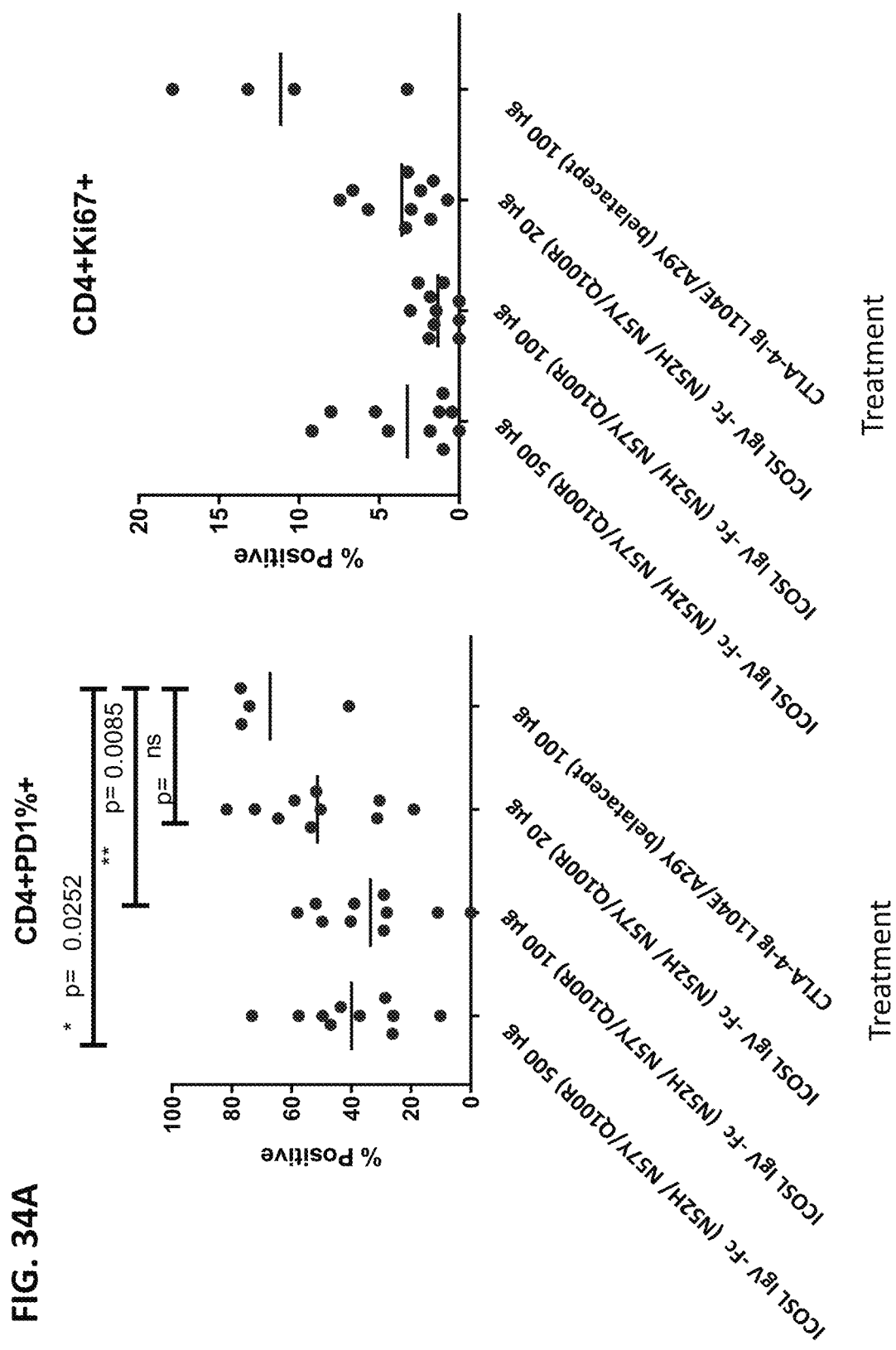
FIGS. 34A-34B depicts expression of activation or exhaustion markers of T cells from Graft-versus-Host-Disease (GvHD) mice treated with various doses (20, 100, or 500 µg) of a variant ICOSL IgV-Fc molecule.
Figure 34B:
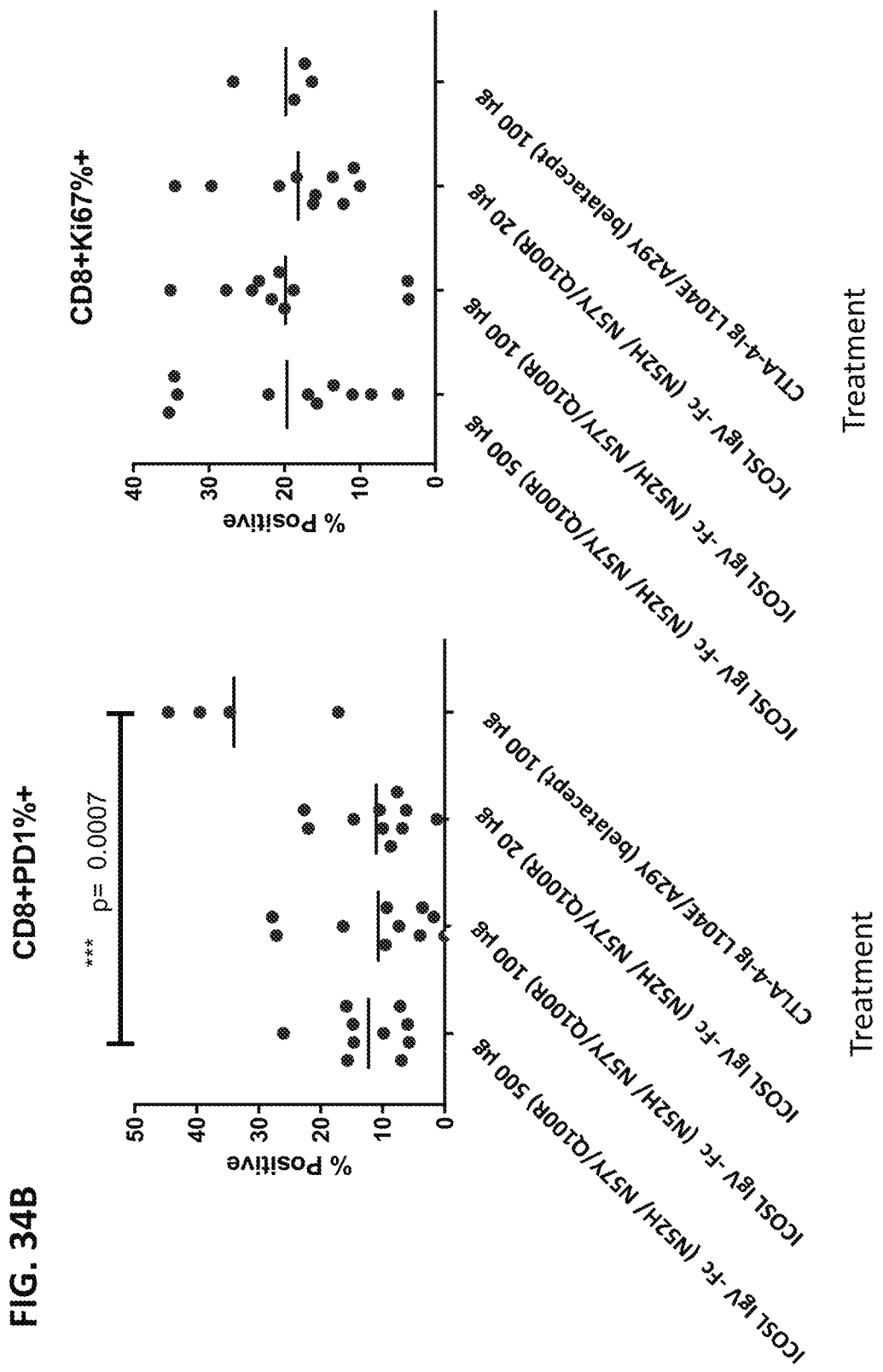

The presence of activation or exhaustion markers of T cells also was suppressed in groups treated with variant ICOSL IgV-Fc (N52H/N57Y/Q100R), as evidenced by lower expression of PD1 in CD4+ and CD8+ T cells and decreased Ki67 expression in CD4+ T cells, (FIGS. 34A-3B). The ratio of effector T cells to Tregs remained stable in groups treated with variant ICOSL IgV-Fc (N52H/N57Y/Q100R) compared to belatacept (FIG. 34C). Serum proinflammatory cytokines also were suppressed in groups treated with variant ICOSL IgV-Fc (N52H/N57Y/Q100R) compared to belatacept (FIGS. 35A-35D).

Pharmacokinetic (PK) analysis also was carried out to monitor serum exposure of variant ICOSL IgV-Fc (N52H/N57Y/Q100R). Test article concentrations were measured in mouse serum samples using a quantitative PK ELISA using an anti-human ICOSL mAb capture antibody and an Fc-specific mouse anti-human IgG as the detection reagent.

Figure 35A:
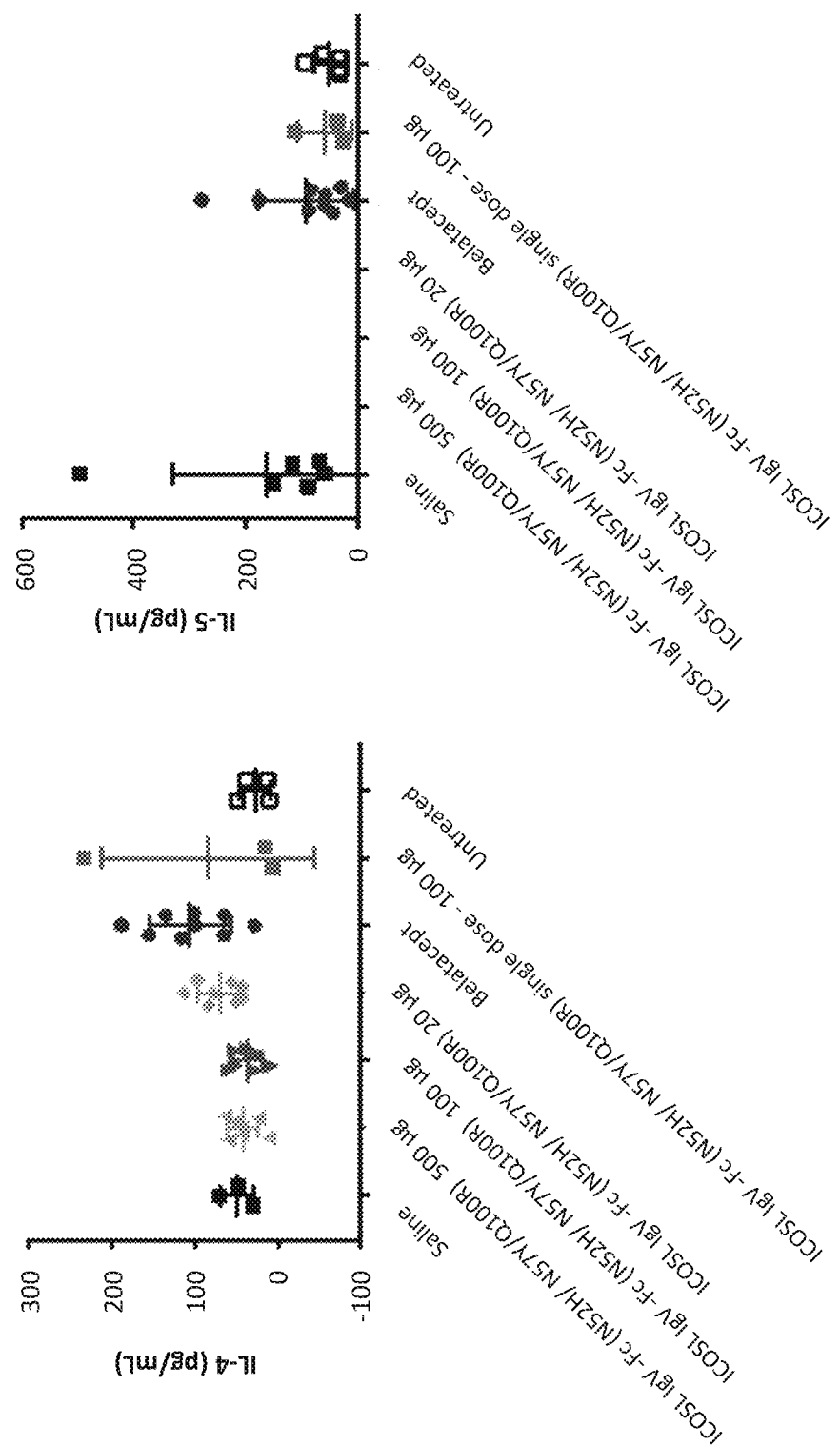
FIGS. 35A-35D depicts serum proinflammatory cytokines from Graft-versus-Host-Disease (GvHD) mice treated with various doses (20, 100, or 500 µg) of a variant ICOSL IgV-Fc molecule.
Figure 35B:
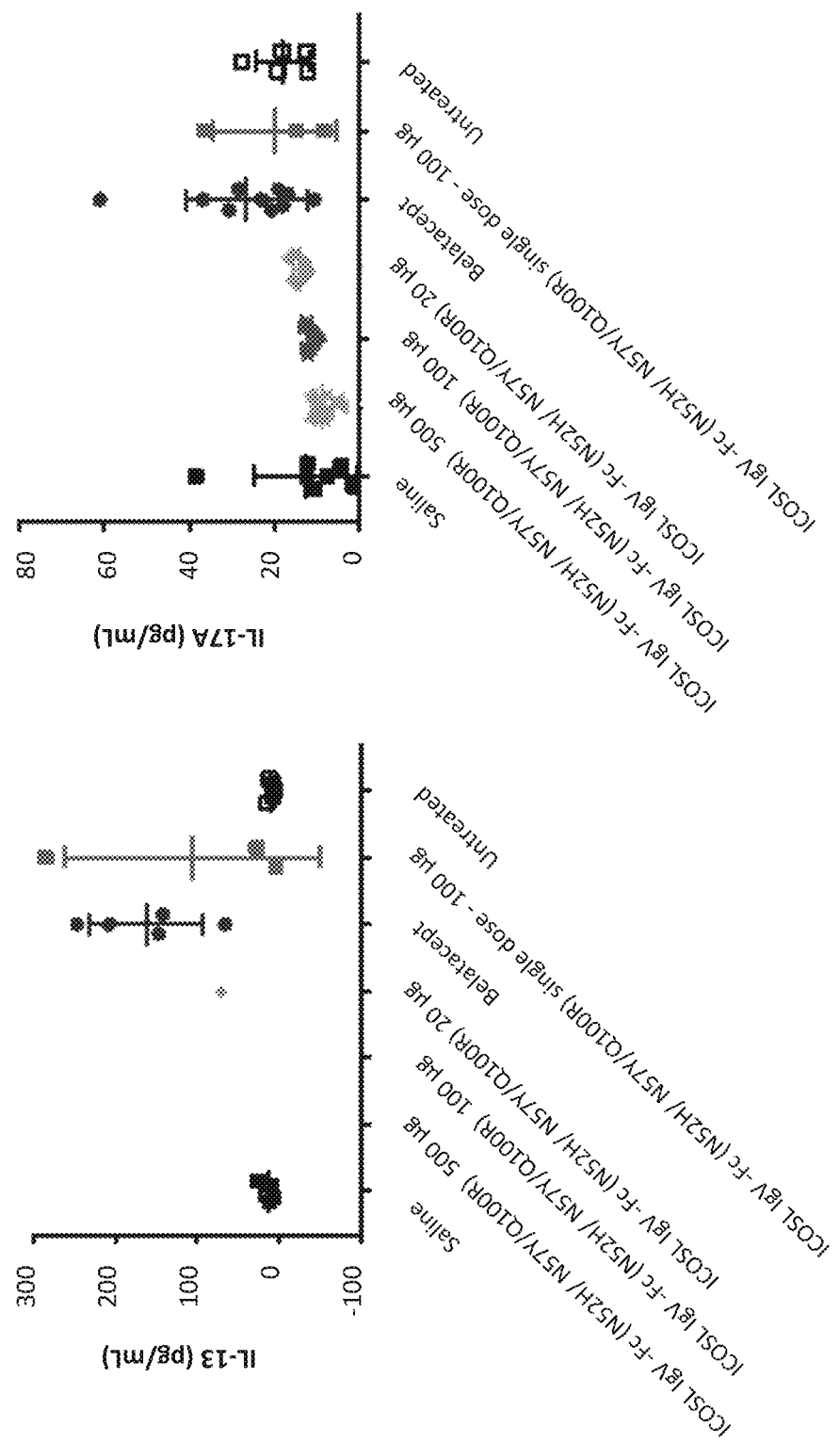
Figure 35C:
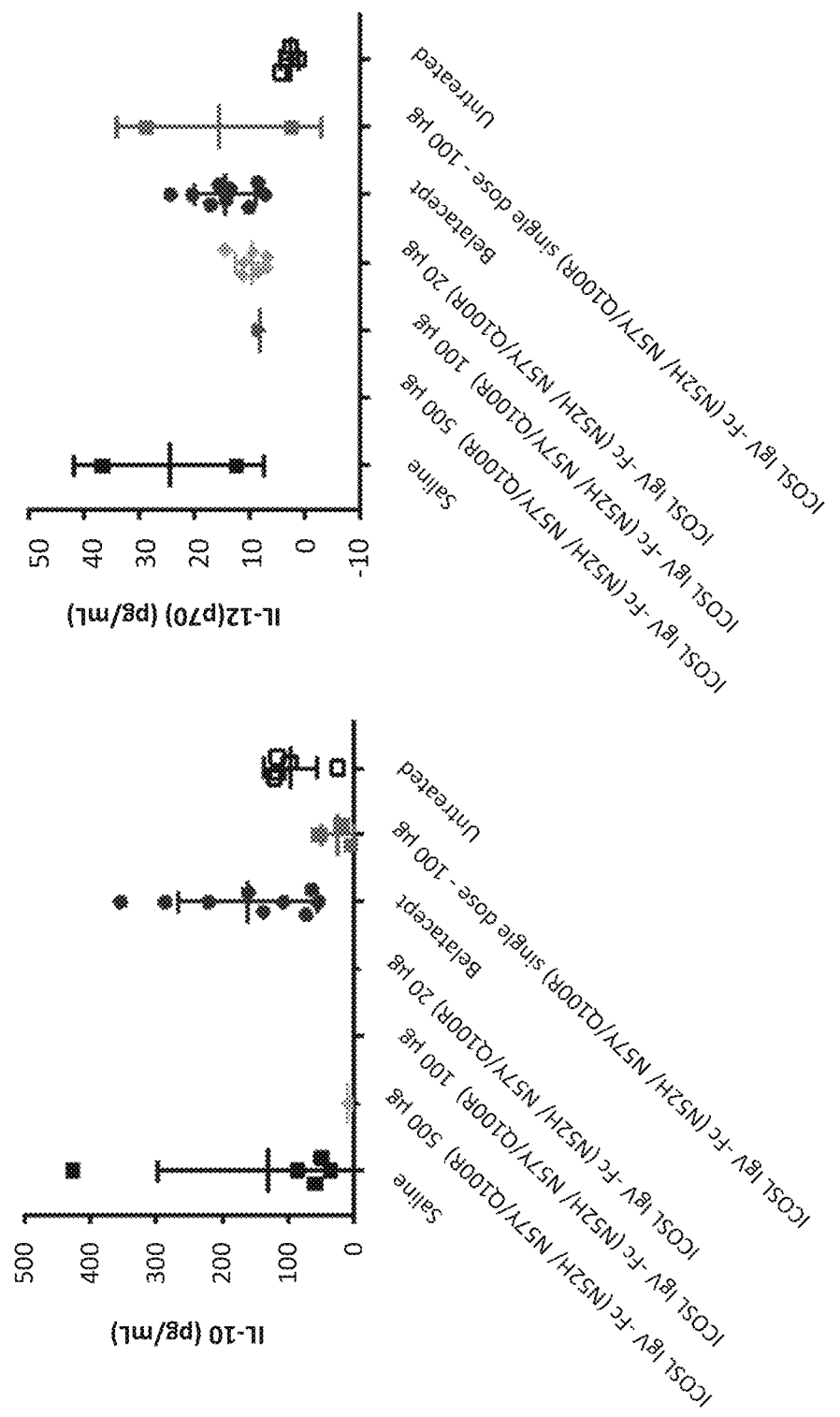
Figure 35D:
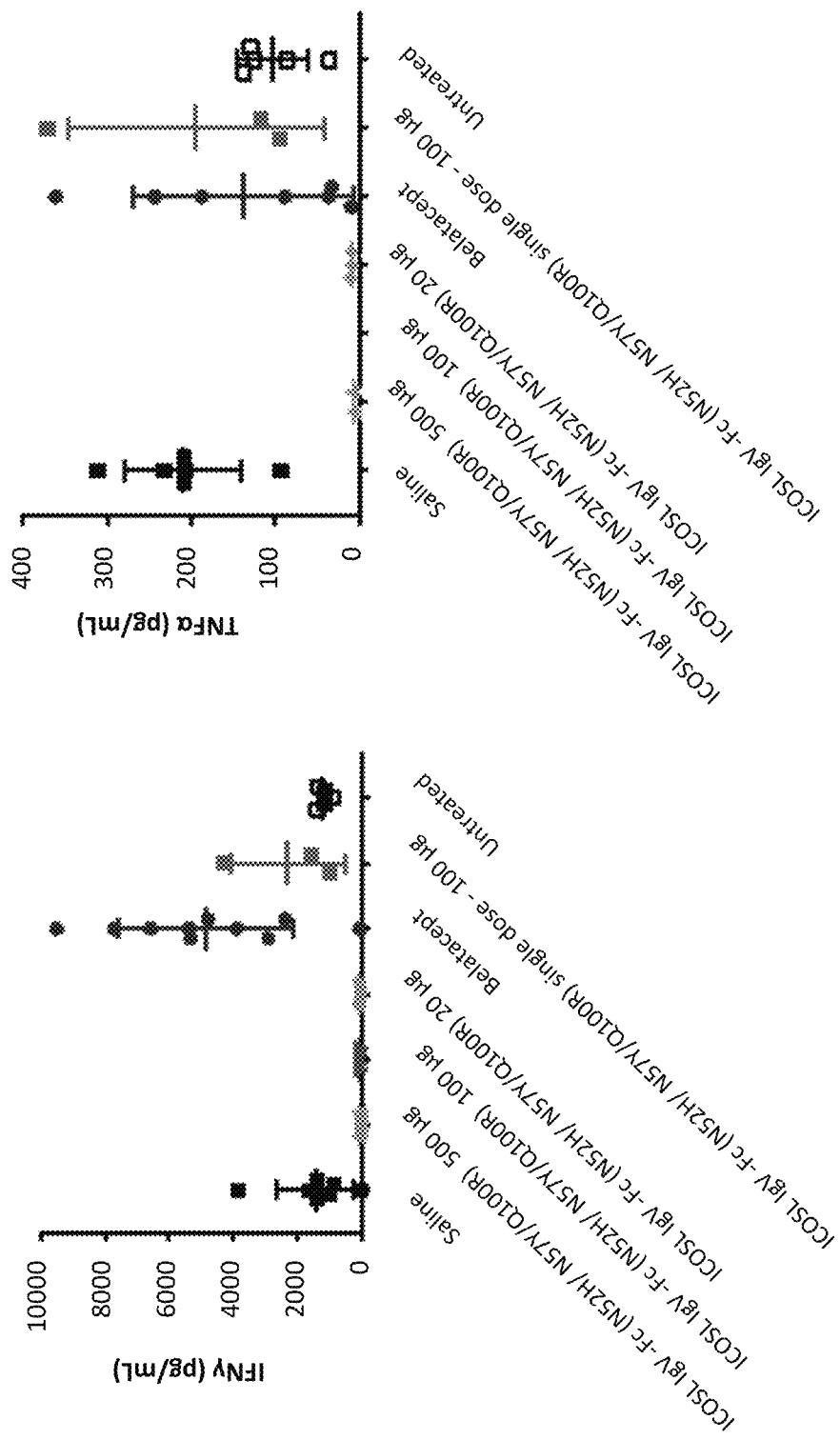
Figure 35E:
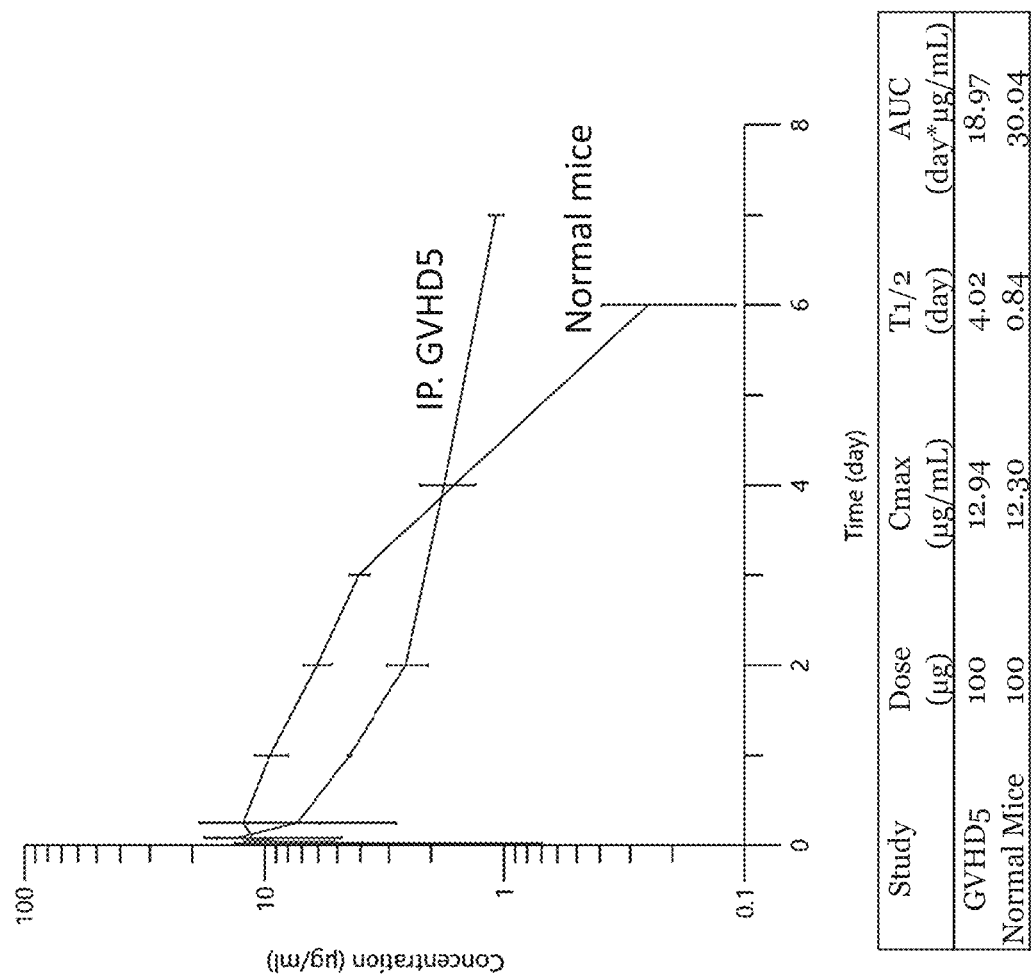
FIG. 35E depicts serum exposure of variant ICOSL IgV-Fc (N52H/N57Y/Q100R) in the GVHD model compared to normal mice.

The observed serum exposure of variant ICOSL IgV-Fc (N52H/N57Y/Q100R) in the GVHD model was 45% lower than that of normal mice, determined in a separate study (FIG. 35E). The longer terminal half-life of variant ICOSL IgV-Fc (N52H/N57Y/Q100R) in the GvHD model may due to reduced target (CD28, ICOS) at later time points in GvHD (as the human T cells disappear), and/or to anti-drug antibody (ADA) formation in normal mice, which can interfere with drug exposure. The observation that variant ICOSL IgV-Fc (N52H/N57Y/Q100R) had lower serum exposure compared to normal mice may be due to target mediated drug disposition (TMDD) in the GvHD model (i.e. its higher affinity for human CD28 and ICOS as compared to the mouse orthologues), and/or to lack of FcRn in the NOD/SCID (NSG) mice used in this model.

Together, these results are consistent with an observation that variant ICOSL IgV-Fc (N52H/N57Y/Q100R) exhibits potent antagonist activity, even with only a single dose, and superior activity to belatacept. This observation may be attributable to the variant ICOSL IgV-Fc (N52H/N57Y/Q100R) exhibiting superior control of ICOS+ T cells, which otherwise escape single ICOS or CD28 pathway blockade, such as that achieved with the CD28 pathway antagonist belatacept.

Example 37

Assessment of Variant ICOSL-IgV Fc in CD4+CD45RBhigh-induced Colitis Model

The effect of the exemplary variant ICOSL IgV-Fc containing a variant ICOSL IgV (N52H/N57Y/Q100R; SEQ ID NO: 565) fused to an inert Fc (containing mutations L234A, L235E and L235E in a human IgG1 Fc, e.g. set forth in SEQ ID NO:637) on disease development in CD4+CD45RBhigh-induced colitis model was evaluated.

CD4+CD45RBhigh donor cells were enriched by negative selection from spleen cell suspensions obtained from 15 male BALB/C donor mice. On Day 0, 0.3 million CD4+CD25-CD45RBhigh (Treg depleted) donor cells were injected intravenously into immunodeficient C.B17 (SCID) mice (n=12 or 21 per group) to induce colitis. As a control, 0.3 million CD4+ cells (containing Treg cells), which do not induce development of colitis in this model, were injected into SCID mice recipients (n=12). On the day of cell transfer, mice in each group were dosed with variant ICOSL-IgV Fc or Fc only or vehicle controls. Table 35 summarizes the treatment regimen for tested groups.

TABLE 35

Treatment Regimens

| Group | # mice | Cells injected | Treatment | Dose | Route | Frequency |
|---|---|---|---|---|---|---|
| 1 | 12 | CD4+ | PBS (sterile) | — | i.p. | 3x/week (M, W, F) |
| 2 | 12 | CD4 + CD45RBhigh | PBS (sterile) | — | i.p. | 3x/week (M, W, F) |
| 3 | 21 | CD4 + CD45RBhigh | Fc control | 300 µg | i.p. | 3x/week (M, W, F) |
| 5 | 12 | CD4 + CD45RBhigh | Variant ICOSL IgV-Fc | 400 µg | i.p. | 3x/week (M, W, F) |

Body weight (taken starting on Day 0) and stool consistency score (taken starting on Day 10), were evaluated three times per week. Daily disease activity index (DAI) was calculated from body weight and stool scores. After the study was terminated on Day 42, colon was collected for determination of length and weight and histological analysis. Statistical analysis of end body weight and end colon weight and length of variant ICOSL-IgV Fc treated group to vehicle group was assessed using two-tailed Student's t-test. Stool scores and DAI scores were compared using Wilcoxon's non-parametric T test.

Figure 36A:
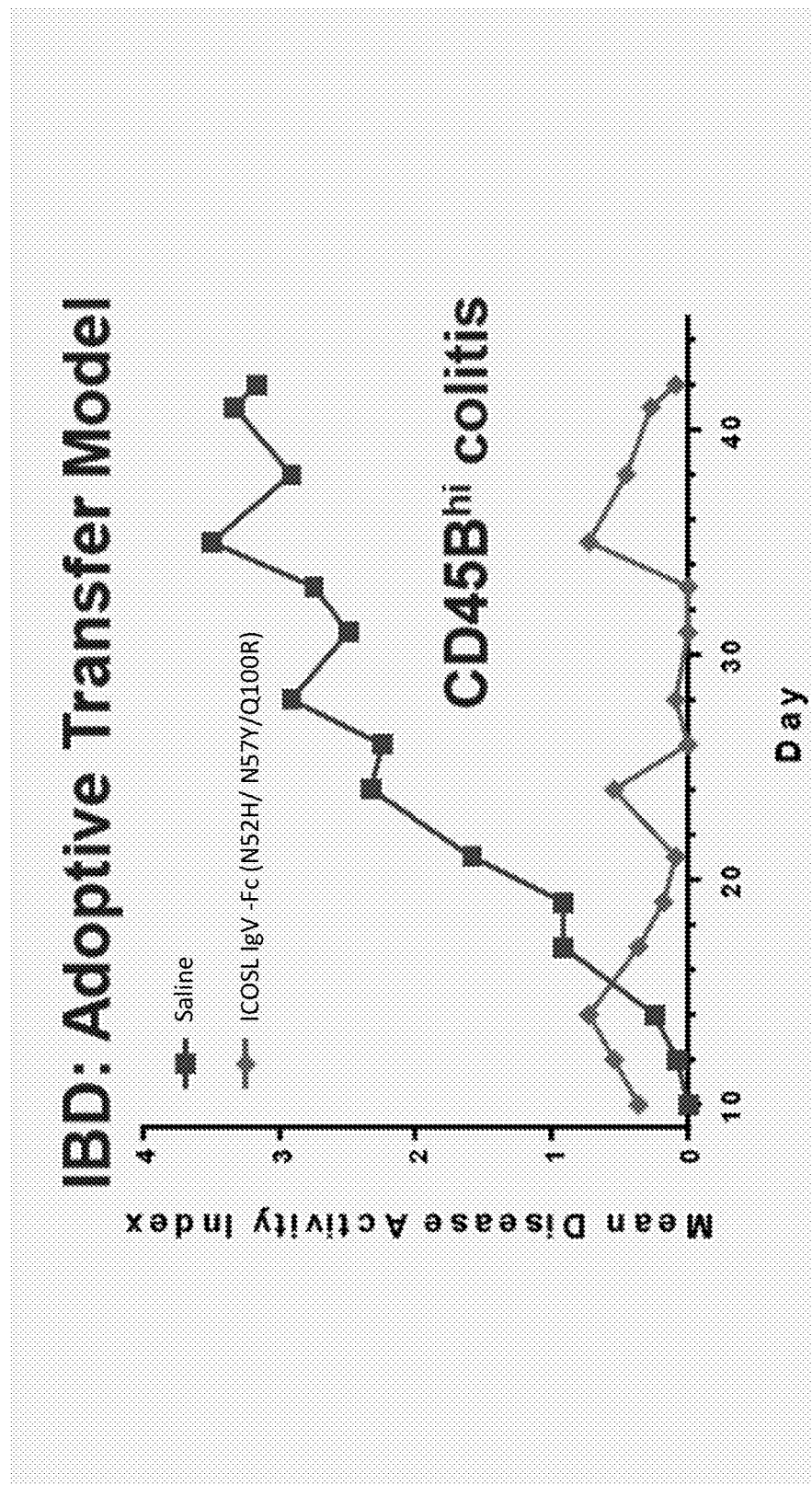
FIG. 36A depicts DAI results and FIG. 36B depicts histology results from treatment with an exemplary variant ICOSL IgV-Fc on disease activity index (DAI) calculated from body weight and stool scores in a CD4+CD45RBhigh-induced colitis model.
Figure 36B:
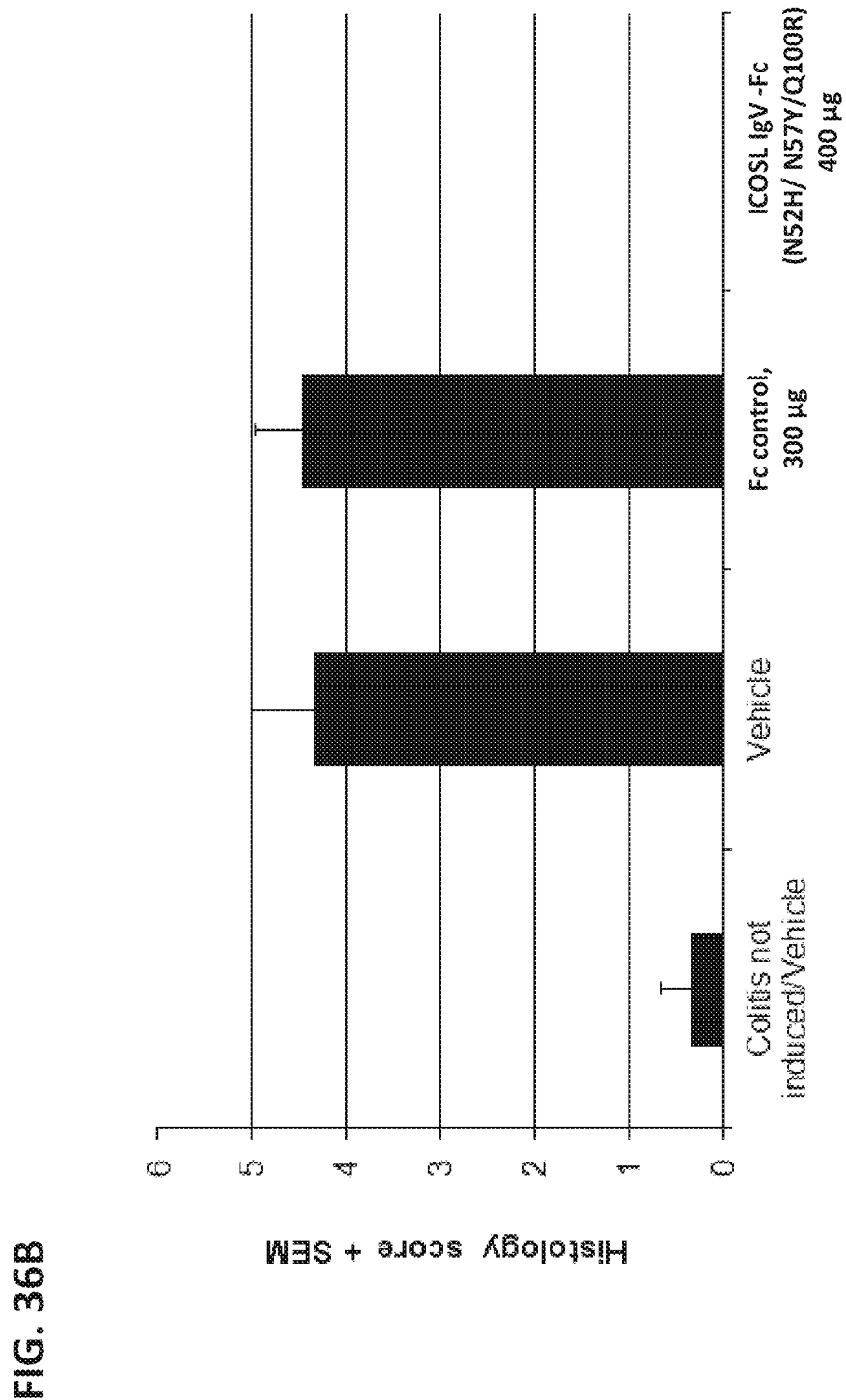

DAI results are shown in Tables 36 (DAI) and FIG. 36A, colon measurements are shown in Table 37, and colon histology results are shown in Table 38 and FIG. 36B. As shown tested variant ICOSL IgV-Fc (N52H/N57Y/Q100R) exhibited significantly reduced development of colitis in this model, which is consistent with the utility of this dual CD28/ICOS antagonist to effectively treat inflammatory bowel disease (IBD).

TABLE 36

Disease Activity Score

| Treatment | End % body weight +/− SD | p value | End stool score +/− SD | p value | End DAI score +/− SD | p value |
|---|---|---|---|---|---|---|
| Colitis not induced/Vehicle | 112.3% +/− 3.9% | | 0.3 +/− 0.5 | | 0.3 +/− 0.5 | |
| Vehicle | 92.7% +/− 11.7% | <0.0001^ | 1.3 +/− 1.3 | 0.0016^ | 3.2 +/− 2.6 | 0.0003^ |
| Fc control, 300 µg | 96.2% +/− 5.4% | 0.2656* | 1.4 +/− 1.4 | 0.8836* | 2.5 +/− 1.7 | 0.6948* |
| ICOSL IgV-Fc (N52H/N57Y/Q100R), 400 µg | 109.6% +/− 4.0% | <0.0001~ | 0.1 +/− 0.3 | 0.0014~ | 0.1 +/− 0.3 | <0.0001~ |

^Compared to Colitis not induced/Vehicle
*Compared to Vehicle
~Compared to Fc control, 300 µg

TABLE 37

Colon Measurements

| Treatment | End colon weight (mg) +/− SD | p value | End colon length (mm) +/− SD | p value | End Colon weight/length +/− SD | p value |
|---|---|---|---|---|---|---|
| Colitis not induced/Vehicle | 175.3 +/− 16.9 | | 82.8 +/− 5.2 | | 2.1 +/− 0.2 | |
| Vehicle | 323.1 +/− 78.0 | <0.0001^ | 77.7 +/− 7.5 | 0.0668^ | 4.2 +/− 1.2 | <0.0001^ |
| Fc control, 300 µg | 276.7 +/− 92.4 | 0.1602* | 77.6 +/− 8.9 | 0.9911* | 3.6 +/− 1.2 | 0.1843* |
| ICOSL IgV-Fc (N52H/N57Y/Q100R), 400 µg | 160.8 +/− 24.4 | 0.0004~ | 79.4 +/− 6.1 | 0.5738~ | 2.0 +/− 0.3 | 0.0003~ |

^Compared to Colitis not induced/Vehicle
*Compared to Vehicle
~Compared to Fc control, 300 µg

TABLE 38

| | | | | Colon (swiss roll) | | | |
|---|---|---|---|---|---|---|---|
| Group | Cage # | Mouse # | Mouse ID# | Mucosa | Submucosa | Muscularis | Total score |
| Colitis not induced/Vehicle | 1 | 1 | 1-1 | 0 | 0 | 0 | 0.0 |
| | | 2 | 1-2 | 0 | 0 | 0 | 0.0 |
| | | 3 | 1-3 | 0 | 0 | 0 | 0.0 |
| | | 4 | 1-4 | 0 | 0 | 0 | 0.0 |
| | 2 | 1 | 2-1 | 1 | 1 | 0 | 2.0 |
| | | 2 | 2-2 | 0 | 0 | 0 | 0.0 |
| | | 3 | 2-3 | | | | |
| | | 4 | 2-4 | | | | |
| | 3 | 1 | 3-1 | | | | |
| | | 2 | 3-2 | | | | |
| | | 3 | 3-3 | | | | |
| | | 4 | 3-4 | | | | |
| | Average | | | 0.2 | 0.2 | 0.0 | 0.3 |
| | Std Dev | | | 0.4 | 0.4 | 0.0 | 0.8 |
| | SEM | | | 0.2 | 0.2 | 0.0 | 0.3 |
| Vehicle | 4 | 1 | 4-1 | 3 | 3 | 1 | 7.0 |
| | | 2 | 4-2 | 1 | 1 | 0 | 2.0 |
| | | 3 | 4-3 | 2 | 2 | 0 | 4.0 |
| | | 4 | 4-4 | 2 | 2 | 0 | 4.0 |
| | 5 | 1 | 5-1 | 2 | 3 | 0 | 5.0 |
| | | 2 | 5-2 | 2 | 2 | 0 | 4.0 |
| | | 3 | 5-3 | | | | |
| | | 4 | 5-4 | | | | |
| | 6a | 1 | 6a-1 | | | | |
| | | 2 | 6a-2 | | | | |
| | | 3 | 6a-3 | | | | |
| | 6b | 1 | 6b-1 | | | | |
| | Average | | | 2.0 | 2.2 | 0.2 | 4.3 |
| | Std Dev | | | 0.6 | 0.8 | 0.4 | 1.6 |
| | SEM | | | 0.3 | 0.3 | 0.2 | 0.7 |
| | T-test vs colitis not induced/Vehicle | | | 0.0001 | 0.0002 | 0.3409 | 0.0003 |
| Fc control, 300 µg | 6b | 2 | 6b-2 | 2 | 1 | 0 | 3.0 |
| | | 3 | 6b-3 | 3 | 3 | 1 | 7.0 |
| | 6c | 1 | 6c-1 | 3 | 3 | 0 | 6.0 |
| | | 2 | 6c-2 | 2 | 2 | 2 | 6.0 |
| | | 3 | 6c-3 | 3 | 2 | 1 | 6.0 |
| | 7 | 1 | 7-1 | | | | |
| | | 2 | 7-2 | 2 | 2 | 1 | 5.0 |
| | | 3 | 7-3 | 2 | 1 | 0 | 3.0 |
| | | 4 | 7-4 | 2 | 3 | 0 | 5.0 |
| | 8 | 1 | 8-1 | 2 | 1 | 0 | 3.0 |
| | | 2 | 8-2 | 2 | 1 | 0 | 3.0 |
| | | 3 | 8-3 | | | | |
| | | 4 | 8-4 | 1 | 1 | 0 | 2.0 |
| | 9 | 1 | 9-1 | | | | |
| | | 2 | 9-2 | | | | |
| | | 3 | 9-3 | | | | |
| | | 4 | 9-4 | | | | |
| | 10 | 1 | 10-1 | | | | |
| | | 2 | 10-2 | | | | |
| | | 3 | 10-3 | | | | |
| | | 4 | 10-4 | | | | |
| | Average | | | 2.2 | 1.8 | 0.5 | 4.5 |
| | Std Dev | | | 0.6 | 0.9 | 0.7 | 1.7 |
| | SEM | | | 0.2 | 0.3 | 0.2 | 0.5 |
| | T-test vs Vehicle | | | 0.5676 | 0.4240 | 0.3663 | 0.8885 |
| ICOSL IgV -Fc (N52H/N57Y/Q100R), 400 µg | 14 | 1 | 14-1 | 0 | 0 | 0 | 0.0 |
| | | 2 | 14-2 | 0 | 0 | 0 | 0.0 |
| | | 3 | 14-3 | 0 | 0 | 0 | 0.0 |
| | | 4 | 14-4 | 0 | 0 | 0 | 0.0 |
| | 15 | 1 | 15-1 | 0 | 0 | 0 | 0.0 |
| | | 2 | 15-2 | 0 | 0 | 0 | 0.0 |
| | | 3 | 15-3 | | | | |
| | | 4 | 15-4 | | | | |
| | 16 | 1 | 16-1 | | | | |
| | | 2 | 16-2 | | | | |
| | | 3 | 16-3 | | | | |
| | | 4 | 16-4 | | | | |
| | Average | | | 0.0 | 0.0 | 0.0 | 0.0 |
| | Std Dev | | | 0.0 | 0.0 | 0.0 | 0.0 |
| | SEM | | | 0.0 | 0.0 | 0.0 | 0.0 |
| | T-test vs Fc control | | | 0.0000 | 0.0002 | 0.1315 | 0.0000 |

The present invention is not intended to be limited in scope to the particular disclosed embodiments, which are provided, for example, to illustrate various aspects of the invention. Various modifications to the compositions and methods described will become apparent from the description and teachings herein. Such variations may be practiced without departing from the true scope and spirit of the disclosure and are intended to fall within the scope of the present disclosure.

SEQUENCE LISTING (933 sequences)

SEQ ID NO: 1 - protein, 288 aa, Homo sapiens
  MISC_FEATURE: CD80(B7-1)
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 2 - protein, 329 aa, Homo sapiens
  MISC_FEATURE: CD86(B7-2)
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 3 - protein, 290 aa, Homo sapiens
  MISC_FEATURE: CD274 (PD-L1, B7-H1)
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 4 - protein, 273 aa, Homo sapiens
  MISC_FEATURE: PDCD1LG2(PD-L2, CD273)
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5 - protein, 302 aa, Homo sapiens
  MISC_FEATURE: ICOSLG(B7RP1, CD275, ICOSL, B7-H2)
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 6 - protein, 534 aa, Homo sapiens
  MISC_FEATURE: CD276(B7-H3)
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 7 - protein, 282 aa, Homo sapiens
  MISC_FEATURE: VTCN1(B7-H4)
MASLGQILFWSIISIIIILAGAIALIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 8 - protein, 220 aa, Homo sapiens
  MISC_FEATURE: CD28
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 9 - protein, 223 aa, Homo sapiens
  MISC_FEATURE: CTLA4
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 10 - protein, 288 aa, Homo sapiens
  MISC_FEATURE: PDCD1(PD-1)
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 11 - protein, 199 aa, Homo sapiens
  MISC_FEATURE: ICOS
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 12 - protein, 289 aa, Homo sapiens
  MISC_FEATURE: BTLA(CD272)
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 13 - protein, 458 aa, Homo sapiens
  MISC_FEATURE: CD4
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 14 - protein, 235 aa, Homo sapiens
  MISC_FEATURE: CD8A(CD8-alpha)
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 15 - protein, 210 aa, Homo sapiens
  MISC_FEATURE: CD8B(CD8-beta)
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 16 - protein, 525 aa, Homo sapiens
  MISC_FEATURE: LAG3
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 17 - protein, 301 aa, Homo sapiens
  MISC_FEATURE: HAVCR2(TIM-3)
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 18 - protein, 526 aa, Homo sapiens
  MISC_FEATURE: CEACAM1
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 19 - protein, 244 aa, Homo sapiens
  MISC_FEATURE: TIGIT
MRWCLLLIWAQGLRQAPLASGMMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 20 - protein, 417 aa, Homo sapiens
  MISC_FEATURE: PVR(CD155)
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 21 - protein, 538 aa, Homo sapiens
  MISC_FEATURE: PVRL2(CD112)
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 22 - protein, 336 aa, Homo sapiens
  MISC_FEATURE: CD226
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 23 - protein, 351 aa, Homo sapiens
  MISC_FEATURE: CD2
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 24 - protein, 180 aa, Homo sapiens
  MISC_FEATURE: CD160
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 25 - protein, 278 aa, Homo sapiens
  MISC_FEATURE: CD200
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 26 - protein, 325 aa, Homo sapiens [sequence omitted]

SEQ ID NO: 27 - protein, 201 aa, Homo sapiens
  MISC_FEATURE: NC R3 (NKp30)
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 28 - protein, 208 aa, Homo sapiens [sequence omitted]

SEQ ID NO: 29 - protein, 224 aa, Homo sapiens
  MISC_FEATURE: CD86(B7-2) ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 30 - protein, 220 aa, Homo sapiens
  MISC_FEATURE: CD274 (PD-L1, B7-H1) ECD
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 31 - protein, 201 aa, Homo sapiens
  MISC_FEATURE: PDCD1LG2(PD-L2, CD273) ECD
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPT

SEQ ID NO: 32 - protein, 238 aa, Homo sapiens [sequence omitted]

SEQ ID NO: 33 - protein, 438 aa, Homo sapiens
  MISC_FEATURE: CD276(B7-H3) ECD
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEA

SEQ ID NO: 34 - protein, 235 aa, Homo sapiens
  MISC_FEATURE: VTCN1(B7-H4) ECD
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKAS

SEQ ID NO: 35 - protein, 134 aa, Homo sapiens
  MISC_FEATURE: CD28 ECD
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKP

SEQ ID NO: 36 - protein, 126 aa, Homo sapiens [sequence omitted]

SEQ ID NO: 37 - protein, 150 aa, Homo sapiens [sequence omitted]

SEQ ID NO: 38 - protein, 120 aa, Homo sapiens
  MISC_FEATURE: ICOS ECD
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLK

SEQ ID NO: 39 - protein, 127 aa, Homo sapiens
  MISC_FEATURE: BTLA(CD272) ECD
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYR

SEQ ID NO: 40 - protein, 371 aa, Homo sapiens
  MISC_FEATURE: CD4 ECD
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 41 - protein, 161 aa, Homo sapiens
  MISC_FEATURE: CD8A(CD8-alpha) ECD
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACD

SEQ ID NO: 42 - protein, 149 aa, Homo sapiens
  MISC_FEATURE: CD8B(CD8-beta) ECD
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSP

SEQ ID NO: 43 - protein, 422 aa, Homo sapiens
  MISC_FEATURE: LAG3 ECD
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHL

SEQ ID NO: 44 - protein, 181 aa, Homo sapiens
  MISC_FEATURE: HAVCR2(TIM-3) ECD
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIG

SEQ ID NO: 45 - protein, 394 aa, Homo sapiens
  MISC_FEATURE: CEACAM1 ECD
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPG

SEQ ID NO: 46 - protein, 120 aa, Homo sapiens
  MISC_FEATURE: TIGIT ECD
MMTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIP

SEQ ID NO: 47 - protein, 323 aa, Homo sapiens
  MISC_FEATURE: PVR(CD155) ECD
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRN

SEQ ID NO: 48 - protein, 329 aa, Homo sapiens
  MISC_FEATURE: PVRL2(CD112) ECD
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGG

SEQ ID NO: 49 - protein, 236 aa, Homo sapiens [sequence omitted]

SEQ ID NO: 50 - protein, 185 aa, Homo sapiens
  MISC_FEATURE: CD2 ECD
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLD

SEQ ID NO: 51 - protein, 133 aa, Homo sapiens
  MISC_FEATURE: CD160 ECD
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLS

SEQ ID NO: 52 - protein, 202 aa, Homo sapiens
  MISC_FEATURE: CD200 ECD
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKG

SEQ ID NO: 53 - protein, 215 aa, Homo sapiens
  MISC_FEATURE: CD200R1(CD200R) ECD
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKL

SEQ ID NO: 54 - protein, 117 aa, Homo sapiens
  MISC_FEATURE: NC R3 (NKp30) ECD
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 55 - protein, 208 aa, Artificial Sequence
  CD80 v1 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 56 - protein, 208 aa, Artificial Sequence
  CD80 v2 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 57 - protein, 208 aa, Artificial Sequence
  CD80 v3 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEAPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 58 - protein, 208 aa, Artificial Sequence
  CD80 v4 ECD
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 59 - protein, 208 aa, Artificial Sequence
  CD80 v5 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 60 - protein, 208 aa, Artificial Sequence
  CD80 v6 ECD
VIHVTKEVKEVATLSCGHNLSVEELAQTRIYWQKEKKMVLTMMSGDMNIWPEYKNRTIFDITNNLSIVIQALRPSDEGTYECVVLKYEKDSFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 61 - protein, 208 aa, Artificial Sequence
  CD80 v7 ECD
VIHVTKEVKEVATLSCGHNVSVEELAQTRIYWQKEKKMVLTMMPGDMNIWPEYKNRTIFDITNNLSIVIQALRPSDEGTYECVVLKYEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 62 - protein, 208 aa, Artificial Sequence
  CD80 v8 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFGIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 63 - protein, 208 aa, Artificial Sequence
  CD80 v9 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 64 - protein, 208 aa, Artificial Sequence
  CD80 v10 ECD
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 65 - protein, 208 aa, Artificial Sequence
  CD80 v11 ECD
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVTLSVKADFPTPSISDFEIPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 66 - protein, 208 aa, Artificial Sequence
  CD80 v12 ECD
VIHVTKEVKEVATLSCGHNVSVEELAQTRIYWQKEKKMVLTMMSGDMNIWPEYKNRTIFDITNNLSIVIQALRPSDEGTYECVVLKNEKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 67 - protein, 208 aa, Artificial Sequence
  CD80 v13 ECD
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 68 - protein, 208 aa, Artificial Sequence
  CD80 v14 ECD
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 69 - protein, 208 aa, Artificial Sequence
  CD80 v15 ECD
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVTLSVKADFPTPSISDFEIPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 70 - protein, 208 aa, Artificial Sequence
  CD80 v16 ECD
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 71 - protein, 208 aa, Artificial Sequence
  CD80 v17 ECD
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 72 - protein, 208 aa, Artificial Sequence
  CD80 v18 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLPVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 73 - protein, 208 aa, Artificial Sequence
  CD80 v19 ECD
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 74 - protein, 208 aa, Artificial Sequence
  CD80 v20 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 75 - protein, 208 aa, Artificial Sequence
  CD80 v21 ECD
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 76 - protein, 208 aa, Artificial Sequence
  CD80 v22 ECD
VIHVTKEVKEVATLSCGHNVSVEELAQTRIYWQKEKKMVLTMMSGDMNIWPEYMNRTIFDITNNLSIVILALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 77 - protein, 208 aa, Artificial Sequence
  CD80 v23 ECD
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVTLSVKADFPTPSISDFEIPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 78 - protein, 208 aa, Artificial Sequence
  CD80 v24 ECD
VIHVTKEVKEVATLSCGHNVSVEELAQTHIYWQKEKKMVLTMMSGDMNIWPGYKNRTIFDITNNLSIVIRALRPSDEGTYECVVLKYGKDGFKREHLAEVTLSVKADFPTPSISDFEIPTSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 79 - protein, 208 aa, Artificial Sequence
  CD80 v25 ECD
VIHVTKEVKEVATLSCGHNVSVEELAQTRIHWQKEKKMVLGMMSGDMNIWPEYKNRTIFDITNNLSIVIQALRPSDEGTYECVVLKYEKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 80 - protein, 208 aa, Artificial Sequence
  CD80 v26 ECD
VIHVTKEVKEVATLSCGHNVSVEELAQTRIYWQKEKKMVLTMMSGDMNIWPEYKNRTIFDITNNLSIAILALRPSDEGTYECVVLKYEKDAFKREHLAEVTLSVKADFPAPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 81 - protein, 208 aa, Artificial Sequence
  CD80 v27 ECD
VIHVTKEVKEVATLSCGHNVSVEELAQTRIYWQKEKKMVLTMMSGDMNIWPEYKNRTIFDITNNLHIVILALRPSDEGTYECVVLKYEKGAFKREHLAEVTLSVKADFPAPSISDLEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 82 - protein, 208 aa, Artificial Sequence
  CD80 v28 ECD
VIHVTKEVKEVATLSCGHNVSVEELAQTHIYWQKEKKMVLTMMSGDMNIWPGYKNRTIFDITNNLSIVILALRPSDEGTYECVVLKYEKDAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 83 - protein, 208 aa, Artificial Sequence
  CD80 v29 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTSSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 84 - protein, 208 aa, Artificial Sequence
  CD80 v30 ECD
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 85 - protein, 208 aa, Artificial Sequence
  CD80 v31 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPAPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 86 - protein, 208 aa, Artificial Sequence
  CD80 v32 ECD
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 87 - protein, 208 aa, Artificial Sequence
  CD80 v33 ECD
VIHVTKEVKEVATLSCGHNVSAEELAQTRIYWQKEKKMVLTMMSGDMNIWPEYKNRTIFDITNNLSIVIQALRPSDEGTYECVVLKYEKDAFKREHLAEVTLSVKADFPTPSISDFEIPTPNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 88 - protein, 208 aa, Artificial Sequence
  CD80 v34 ECD
VIHVTKEVKEVVTLFCGHNVSVEELAQTRIHWQKEKKMVLGMMSGDMNIWPEYKNRTIFDITNNLSIVILALRPSDEGTYECVVLKYEKDAFKREHLAEVTLSVKADFPTPSISDFEIPTSNIRRIICSASGGFPELHLSWLENGEELNAITTTVSQDPETELYAVSSKLDFNMTTNHSFMCLIKYGHLRVNQTFNWNTTKQEHFPDN

SEQ ID NO: 89 - protein, 208 aa, Artificial Sequence
  CD80 v35 ECD
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVTLSVKADFPTPSISDFEIPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 90 - protein, 208 aa, Artificial Sequence
  CD80 v36 ECD
VIHVTKEVKEVATLSCGHNVSVEGPAQTRIYWQKEKKMVLTMMSGDMNIWPEYKNRTIFDITNNLSIVIQALRPSDEGTYECVVLKYEKDAFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 91 - protein, 208 aa, Artificial Sequence
  CD80 v37 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVTLSVKADLPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 92 - protein, 208 aa, Artificial Sequence
  CD80 v38 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFETPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 93 - protein, 208 aa, Artificial Sequence
  CD80 v39 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLESGEELSAINTTVSQDPETELYAVSSKLDFNMTTNHSFMCLIKYGHLRVNQTFNWNTTKQEHFPDN

SEQ ID NO: 94 - protein, 208 aa, Artificial Sequence
  CD80 v40 ECD
VIHVTKEVKEVATLSCGHNVSVEELAQTDILWHKEGKIVLATRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLENGEESSAINTTVSQDPETELYAVSSKLDFNMTTNHSFMCLIKYGHLRVNQTFNWNTTKQEHFPDN

SEQ ID NO: 95 - protein, 208 aa, Artificial Sequence
  CD80 v41 ECD
VIHVTKEVKEVATLSCGHNVSVEGLAQTDILWHKEGKIVLAMRSGDTNIWPEYKNRTILDITNNLSIVILALRPSDEGTYVCVVRKYENDTPVLERLAEVTLSVKADFPTPSISDFEIPTSNIRRIICSTSGGFPEPHLSWLENGEELSAINTTVSQDPETELYAVSSKLDFNMTTNHSFMSLIKYGHLRVNQTFNWNTTKQEHFPDN

SEQ ID NO: 96 - protein, 208 aa, Artificial Sequence
  CD80 v42 ECD
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVTLSVKADFPTPSISDFEIPTSNIRRIICSTSGGFPEPHLSWLENGEELSAINTTVSQDPETELYAVSSKLDFNMTTNHSFMCLIKYGHLRVNQTFNWNTTKQEHFPDN

SEQ ID NO: 97 - protein, 208 aa, Artificial Sequence
  CD80 v43 ECD
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 98 - protein, 208 aa, Artificial Sequence
  CD80 v44 ECD
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 99 - protein, 208 aa, Artificial Sequence
  CD80 v45 ECD
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKADFPTPSISDFEIPTSSIRRIICSTSGGFPEPHLSWLENGEELNAINTTVSQDPETELYAVSSKLDFNMTTSHSFMCLIKYGHLRVNQTFNWNTTKQEHFPDN

SEQ ID NO: 100 - protein, 208 aa, Artificial Sequence
  CD80 v46 ECD
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 101 - protein, 208 aa, Artificial Sequence
  CD80 v47 ECD
VIHVTKEVKEVATLSCGHNVSVEELAQTRIYWQKEGQIVLTMMSGDMNIWPEYKNRTILDITNNLSIVILALRPSDEGTYVCVVRKYENDTPVLEHLAGVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 102 - protein, 208 aa, Artificial Sequence
  CD80 v48 ECD
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 103 - protein, 208 aa, Artificial Sequence
  CD80 v49 ECD
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 104 - protein, 208 aa, Artificial Sequence
  CD80 v50 ECD
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 105 - protein, 208 aa, Artificial Sequence
  CD80 v51 ECD
VIHVTKEVKEVATLSCGHNVSVEELAQTHIHWQKEKKMVLGMMSGDMNIWPEYKNRTIFDITNNLSIVILALRPSDEGTYECVVLKNGENGFKREHLAEVTLSVKADFSTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 106 - protein, 208 aa, Artificial Sequence
  CD80 v52 ECD
VIHVTKEVKEVTTLSCGLNVSVEELAQTRIYWQKEKKMVLTMVSGDMNIWPEYKNRTILDITNNLSIVILALRPSDKGTYECVVLKYEKDAFKREHLAEVTLSVKADFSTPSISDFETPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 107 - protein, 208 aa, Artificial Sequence
  CD80 v53 ECD
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 108 - protein, 208 aa, Artificial Sequence
  CD80 v54 ECD
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 109 - protein, 238 aa, Artificial Sequence
  ICOSL v1 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 110 - protein, 238 aa, Artificial Sequence
  ICOSL v2 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 111 - protein, 238 aa, Artificial Sequence
  ICOSL v3 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 112 - protein, 238 aa, Artificial Sequence
  ICOSL v4 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 113 - protein, 238 aa, Artificial Sequence
  ICOSL v5 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 114 - protein, 238 aa, Artificial Sequence
  ICOSL v6 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGCPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 115 - protein, 238 aa, Artificial Sequence
  ICOSL v7 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 116 - protein, 238 aa, Artificial Sequence
  ICOSL v8 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTDTSINGYPRPNVYWINKTDNSLLDQALQNDTVFLNMRGLYDVVSVLRIARTPSVNIGCCIENVLLQQNLTVGSQTGNDIGERDKIAENPVSTGEKNAAT

SEQ ID NO: 117 - protein, 238 aa, Artificial Sequence
  ICOSL v9 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKIAENPVSTGEKNAAT

SEQ ID NO: 118 - protein, 238 aa, Artificial Sequence
  ICOSL v10 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 119 - protein, 238 aa, Artificial Sequence
  ICOSL v11 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 120 - protein, 238 aa, Artificial Sequence
  ICOSL v12 ECD
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 121 - protein, 238 aa, Artificial Sequence
  ICOSL v13 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 122 - protein, 238 aa, Artificial Sequence
  ICOSL v14 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 123 - protein, 238 aa, Artificial Sequence
  ICOSL v15 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHGPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 124 - protein, 238 aa, Artificial Sequence
  ICOSL v16 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 125 - protein, 238 aa, Artificial Sequence
  ICOSL v17 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 126 - protein, 238 aa, Artificial Sequence
  ICOSL v18 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVCWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 127 - protein, 238 aa, Artificial Sequence
  ICOSL v19 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSVPVVSAPPSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 128 - protein, 238 aa, Artificial Sequence
  ICOSL v20 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSPLDQALQNDTVFLNMRGLYDVVSVLRIARTPSVNIGCRIENVLLQQNLTVGSQTGNDIGERDKITENPVSTGEKNAAT

SEQ ID NO: 129 - protein, 238 aa, Artificial Sequence
  ICOSL v21 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVELHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 130 - protein, 238 aa, Artificial Sequence
  ICOSL v22 ECD
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 131 - protein, 238 aa, Artificial Sequence
  ICOSL v23 ECD
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 132 - protein, 238 aa, Artificial Sequence
  ICOSL v24 ECD
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNPTVGSQTGNDIGERDKITENPVSTGEKNAAT

SEQ ID NO: 133 - protein, 238 aa, Artificial Sequence
  ICOSL v25 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVHWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 134 - protein, 238 aa, Artificial Sequence
  ICOSL v26 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNAYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 135 - protein, 238 aa, Artificial Sequence
  ICOSL v27 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSTNGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 136 - protein, 238 aa, Artificial Sequence
  ICOSL v28 ECD
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 137 - protein, 238 aa, Artificial Sequence
  ICOSL v29 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVHWINKTDNSLLDQALQNDTVFLNMRGLYDVVSVLRIARTPSVNIGCCIESVLLQQNLTVGSQTGNDIGERDKITENPVSTGEKNAAT

SEQ ID NO: 138 - protein, 238 aa, Artificial Sequence
  ICOSL v30 ECD
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 139 - protein, 238 aa, Artificial Sequence
  ICOSL v31 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTGNSLLDQALQNDTVFLNMRGLYDVVSVLRIARTPSVNIGCCIENVLLQQNLTVGSQTGNDIGERDKITENPVSTGEKNAAT

SEQ ID NO: 140 - protein, 238 aa, Artificial Sequence
  ICOSL v32 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSHDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 141 - protein, 238 aa, Artificial Sequence
  ICOSL v33 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 142 - protein, 238 aa, Artificial Sequence
  ICOSL v34 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 143 - protein, 117 aa, Artificial Sequence
  NKp30 v1 ECD
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLG

SEQ ID NO: 144 - protein, 117 aa, Artificial Sequence
  NKp30 v2 ECD
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQLG

SEQ ID NO: 145 - protein, 117 aa, Artificial Sequence
  NKp30 v3 ECD
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQLG

SEQ ID NO: 146 - protein, 117 aa, Artificial Sequence
  NKp30 v4 ECD
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQLG

SEQ ID NO: 147 - protein, 117 aa, Artificial Sequence
  NKp30 v5 ECD
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQLG

SEQ ID NO: 148 - protein, 224 aa, Artificial Sequence
  CD86 v1 ECD
APLKIQAYFNETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 149 - protein, 224 aa, Artificial Sequence
  CD86 v2 ECD
APLKIQAYFNETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 150 - protein, 224 aa, Artificial Sequence
  CD86 v3 ECD
APLKIQAYFNETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 151 - protein, 224 aa, Artificial Sequence
  CD86 v4 ECD
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIP

SEQ ID NO: 152 - protein, 101 aa, Homo sapiens
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVT

SEQ ID NO: 153 - protein, 101 aa, Artificial Sequence
  CD80 v1 IgV
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVT

SEQ ID NO: 154 - protein, 101 aa, Artificial Sequence
  CD80 v4 IgV
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVT

SEQ ID NO: 155 - protein, 101 aa, Artificial Sequence
  CD80 v6 IgV
VIHVTKEVKEVATLSCGHNLSVEELAQTRIYWQKEKKMVLTMMSGDMNIWPEYKNRTIFDITNNLSIVIQALRPSDEGTYECVVLKYEKDSFKREHLAEVT

SEQ ID NO: 156 - protein, 101 aa, Artificial Sequence
  CD80 v7 IgV
VIHVTKEVKEVATLSCGHNVSVEELAQTRIYWQKEKKMVLTMMPGDMNIWPEYKNRTIFDITNNLSIVIQALRPSDEGTYECVVLKYEKDGFKREHLAEVT

SEQ ID NO: 157 - protein, 101 aa, Artificial Sequence
  CD80 v9 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVT

SEQ ID NO: 158 - protein, 101 aa, Artificial Sequence
  CD80 v10 IgV
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVT

SEQ ID NO: 159 - protein, 101 aa, Artificial Sequence
  CD80 v11 IgV
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVT

SEQ ID NO: 160 - protein, 101 aa, Artificial Sequence
  CD80 v12 IgV
VIHVTKEVKEVATLSCGHNVSVEELAQTRIYWQKEKKMVLTMMSGDMNIWPEYKNRTIFDITNNLSIVIQALRPSDEGTYECVVLKNEKDGFKREHLAEVT

SEQ ID NO: 161 - protein, 101 aa, Artificial Sequence
  CD80 v13 IgV
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVT

SEQ ID NO: 162 - protein, 101 aa, Artificial Sequence
  CD80 v14 IgV
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVT

SEQ ID NO: 163 - protein, 101 aa, Artificial Sequence
  CD80 v15 IgV
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVT

SEQ ID NO: 164 - protein, 101 aa, Artificial Sequence
  CD80 v16 IgV
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVT

SEQ ID NO: 165 - protein, 101 aa, Artificial Sequence
  CD80 v17 IgV
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVT

SEQ ID NO: 166 - protein, 101 aa, Artificial Sequence
  CD80 v19 IgV
VIHVTKEVKEVATLSCGHNVSVEELAQTRIYWQKEKKMVLTMMSGDMNIWPEYKNRTIFDITNNLSIVILALRPSDEGTYECVVLKYEEDAFKREHLAEVT

SEQ ID NO: 167 - protein, 101 aa, Artificial Sequence
  CD80 v21 IgV
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVT

SEQ ID NO: 168 - protein, 101 aa, Artificial Sequence
  CD80 v22 IgV
VIHVTKEVKEVATLSCGHNVSVEELAQTRIYWQKEKKMVLTMMSGDMNIWPEYMNRTIFDITNNLSIVILALRPSDEGTYECVVLKYEKDGFKREHLAEVT

SEQ ID NO: 169 - protein, 101 aa, Artificial Sequence
  CD80 v23 IgV
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVT

SEQ ID NO: 170 - protein, 101 aa, Artificial Sequence
  CD80 v24 IgV
VIHVTKEVKEVATLSCGHNVSVEELAQTHIYWQKEKKMVLTMMSGDMNIWPGYKNRTIFDITNNLSIVIRALRPSDEGTYECVVLKYGKDGFKREHLAEVT

SEQ ID NO: 171 - protein, 101 aa, Artificial Sequence
  CD80 v25 IgV
VIHVTKEVKEVATLSCGHNVSVEELAQTRIHWQKEKKMVLGMMSGDMNIWPEYKNRTIFDITNNLSIVIQALRPSDEGTYECVVLKYEKDGFKREHLAEVT

SEQ ID NO: 172 - protein, 101 aa, Artificial Sequence
  CD80 v26 IgV
VIHVTKEVKEVATLSCGHNVSVEELAQTRIYWQKEKKMVLTMMSGDMNIWPEYKNRTIFDITNNLSIAILALRPSDEGTYECVVLKYEKDAFKREHLAEVT

SEQ ID NO: 173 - protein, 101 aa, Artificial Sequence
  CD80 v27 IgV
VIHVTKEVKEVATLSCGHNVSVEELAQTRIYWQKEKKMVLTMMSGDMNIWPEYKNRTIFDITNNLHIVILALRPSDEGTYECVVLKYEKGAFKREHLAEVT

SEQ ID NO: 174 - protein, 101 aa, Artificial Sequence
  CD80 v28 IgV
VIHVTKEVKEVATLSCGHNVSVEELAQTHIYWQKEKKMVLTMMSGDMNIWPGYKNRTIFDITNNLSIVILALRPSDEGTYECVVLKYEKDAFKREHLAEVT

SEQ ID NO: 175 - protein, 101 aa, Artificial Sequence
  CD80 v30 IgV
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVT

SEQ ID NO: 176 - protein, 101 aa, Artificial Sequence
  CD80 v32 IgV
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVT

SEQ ID NO: 177 - protein, 101 aa, Artificial Sequence
  CD80 v33 IgV
VIHVTKEVKEVATLSCGHNVSAEELAQTRIYWQKEKKMVLTMMSGDMNIWPEYKNRTIFDITNNLSIVIQALRPSDEGTYECVVLKYEKDAFKREHLAEVT

SEQ ID NO: 178 - protein, 101 aa, Artificial Sequence
  CD80 v34 IgV
VIHVTKEVKEVVTLFCGHNVSVEELAQTRIHWQKEKKMVLGMMSGDMNIWPEYKNRTIFDITNNLSIVILALRPSDEGTYECVVLKYEKDAFKREHLAEVT

SEQ ID NO: 179 - protein, 101 aa, Artificial Sequence
  CD80 v35 IgV
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVT

SEQ ID NO: 180 - protein, 101 aa, Artificial Sequence
  CD80 v36 IgV
VIHVTKEVKEVATLSCGHNVSVEGPAQTRIYWQKEKKMVLTMMSGDMNIWPEYKNRTIFDITNNLSIVIQALRPSDEGTYECVVLKYEKDAFKREHLAEVT

SEQ ID NO: 181 - protein, 101 aa, Artificial Sequence
  CD80 v37 IgV
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVT

SEQ ID NO: 182 - protein, 101 aa, Artificial Sequence
  CD80 v38 IgV
VIHVTKEVKEVATLSCGHNVSVEELAQTDILWHKEGKIVLAMRSGDTNIWPEYKNRTIFDITNNLSIVILALRPSDEGTYVCVVRKYENDTPVLEHLAEVT

SEQ ID NO: 183 - protein, 101 aa, Artificial Sequence
  CD80 v40 IgV
VIHVTKEVKEVATLSCGHNVSVEELAQTDILWHKEGKIVLATRSGDTNIWPEYKNRTIFDITNNLSIVILALRPSDEGTYVCVVRKYENDTPVLEHLAEVT

SEQ ID NO: 184 - protein, 101 aa, Artificial Sequence
  CD80 v41 IgV
VIHVTKEVKEVATLSCGHNVSVEGLAQTDILWHKEGKIVLAMRSGDTNIWPEYKNRTILDITNNLSIVILALRPSDEGTYVCVVRKYENDTPVLERLAEVT

SEQ ID NO: 185 - protein, 101 aa, Artificial Sequence
  CD80 v43 IgV
VIHVTKEVKEVATLSCGHNVSVEELAQTVIYWQKEKKMVLTMQSGDMNIWPEYKNRTIFDITNNLSIVILALRPSDEGTYRCVVIKYERLENQGEHLAEVT

SEQ ID NO: 186 - protein, 101 aa, Artificial Sequence
  CD80 v44 IgV
VIHVTKEVKEVATLSCGHNVSVEELAQTRIYWQKEKKMVLIMMSGDMNIWPEYKNRTIFDITNNLSIVILALRPSDEGTYECVVLKYEKDGFKREHLAEVT

SEQ ID NO: 187 - protein, 101 aa, Artificial Sequence
  CD80 v45 IgV
VIHVTKEVKEVATLSCGHNVSVEELAQTRIYWQKEKKMVLTMMSGDMNIWPEYKNRTIFDITNNLSIVILALRPSDEGTYECVVLKYERKGYRREHLAEVT

SEQ ID NO: 188 - protein, 101 aa, Artificial Sequence
  CD80 v47 IgV
VIHVTKEVKEVATLSCGHNVSVEELAQTRIYWQKEGQIVLTMMSGDMNIWPEYKNRTILDITNNLSIVILALRPSDEGTYVCVVRKYENDTPVLEHLAGVT

SEQ ID NO: 189 - protein, 101 aa, Artificial Sequence
  CD80 v48 IgV
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVT

SEQ ID NO: 190 - protein, 101 aa, Artificial Sequence
  CD80 v49 IgV
VIHVTKEVKEVATLSCGHNVSVEELAQTRIYWQKEGQIVMTMMSGDMNIWPEYKNRTIFDITNNLSIVILALRPSDEGTYECVVLKYEKDAFKREHLAEVT

SEQ ID NO: 191 - protein, 101 aa, Artificial Sequence
  CD80 v50 IgV
VIHVTKEVKEVATLSCGHNVSVEELAQTRIYWQKEGKMVLTMMSGDMNIWPEYKNRTIFDITNNLSIVILALRPSDEGTYECVVLKYEKDAFKREHLAEVT

SEQ ID NO: 192 - protein, 101 aa, Artificial Sequence
  CD80 v51 IgV
VIHVTKEVKEVATLSCGHNVSVEELAQTHIHWQKEKKMVLGMMSGDMNIWPEYKNRTIFDITNNLSIVILALRPSDEGTYECVVLKNGENGFKREHLAEVT

SEQ ID NO: 193 - protein, 101 aa, Artificial Sequence
  CD80 v52 IgV
VIHVTKEVKEVTTLSCGLNVSVEELAQTRIYWQKEKKMVLTMVSGDMNIWPEYKNRTILDITNNLSIVILALRPSDKGTYECVVLKYEKDAFKREHLAEVT

SEQ ID NO: 194 - protein, 101 aa, Artificial Sequence
  CD80 v53 IgV
VIHVTKEVKEVATLSCGHNVSVEELAQTVIFWQKEGKLVLTMQSGDMNIWPEYKNRTIFDITNNLSIVILALRPSDEGTYRCIVIKYERLENQGEHLAEVT

SEQ ID NO: 195 - protein, 101 aa, Artificial Sequence
  CD80 v54 IgV
VIHVTKEVKEVATLSCGHNVSVEELAQTRIYWQKEKKMVLTMMSGDMNIWPEYKNRTIFDITNNLSIMIPAPRPSDEGTYECVVLEYEKDAFKREHLAEVT

SEQ ID NO: 196 - protein, 111 aa, Artificial Sequence
  ICOSL WT IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVE

SEQ ID NO: 197 - protein, 111 aa, Artificial Sequence
  ICOSL v1 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVE

SEQ ID NO: 198 - protein, 111 aa, Artificial Sequence
  ICOSL v2 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVE

SEQ ID NO: 199 - protein, 111 aa, Artificial Sequence
  ICOSL v3 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVE

SEQ ID NO: 200 - protein, 111 aa, Artificial Sequence
  ICOSL v4 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVE

SEQ ID NO: 201 - protein, 111 aa, Artificial Sequence
  ICOSL v5 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVE

SEQ ID NO: 202 - protein, 111 aa, Artificial Sequence
  ICOSL v10 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVE

SEQ ID NO: 203 - protein, 111 aa, Artificial Sequence
  ICOSL v11 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVE

SEQ ID NO: 204 - protein, 111 aa, Artificial Sequence
  ICOSL v12 IgV
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVE

SEQ ID NO: 205 - protein, 111 aa, Artificial Sequence
  ICOSL v13 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVE

SEQ ID NO: 206 - protein, 111 aa, Artificial Sequence
  ICOSL v14 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVE

SEQ ID NO: 207 - protein, 111 aa, Artificial Sequence
  ICOSL v22 IgV
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVE

SEQ ID NO: 208 - protein, 111 aa, Artificial Sequence
  ICOSL v23 IgV
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVE

SEQ ID NO: 209 - protein, 111 aa, Artificial Sequence
  ICOSL v24 IgV
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVE

SEQ ID NO: 210 - protein, 111 aa, Artificial Sequence
  ICOSL v28 IgV
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVE

SEQ ID NO: 211 - protein, 111 aa, Artificial Sequence
  ICOSL v30 IgV
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVE

SEQ ID NO: 212 - protein, 111 aa, Artificial Sequence
  ICOSL v33 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVE

SEQ ID NO: 213 - protein, 111 aa, Artificial Sequence
  ICOSL v34 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVE

SEQ ID NO: 214 - protein, 108 aa, Homo sapiens
  MISC_FEATURE: NKp30 WT IgC-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLV

SEQ ID NO: 215 - protein, 108 aa, Artificial Sequence
  NKp30 v1 IgC-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLV

SEQ ID NO: 216 - protein, 108 aa, Artificial Sequence
  NKp30 v2 IgC-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLV

SEQ ID NO: 217 - protein, 108 aa, Artificial Sequence
  NKp30 v3 IgC-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLV

SEQ ID NO: 218 - protein, 108 aa, Artificial Sequence
  NKp30 v4 IgC-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLV

SEQ ID NO: 219 - protein, 108 aa, Artificial Sequence
  NKp30 v5 IgC-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLV

SEQ ID NO: 220 - protein, 99 aa, Homo Sapiens
  MISC_FEATURE: CD86 WT IgV
NETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELS

SEQ ID NO: 221 - protein, 99 aa, Artificial Sequence
  CD86 v1 IgV
NETADLPCQFANSQNQSLSELVVFWHDQENLVLNEVYLGKEKFDSVHSKYMGRTSFDSDSWTLRLHNLQIKDKGLYQCIILHKKPTGMIRIHHMNSELS

SEQ ID NO: 222 - protein, 99 aa, Artificial Sequence
  CD86 v2 IgV
NETADLPCQFANSQNQSLSELVVFWHDQENLVLNEVYLGKEKFDSVHSKYMGRTSFDSDSWTLRLHNLQIKDKGLYQCIIHHKKPTGMIRIHQMNSELS

SEQ ID NO: 223 - protein, 99 aa, Artificial Sequence
  CD86 v3 IgV
NETADLPCQFANSQNQSLSELVVFWQDQENLVLNEVYLGKEKFDSVHSKYMGRTSFDSDSWTLRLHNLQIKDKGLYQCIILHKKPTGMIRIHQMNSELS

SEQ ID NO: 224 - protein, 99 aa, Artificial Sequence
  CD86 v4 IgV
NETADLPCQFANSQNQSLSELVVFWQDQENLVLNEVYLGKEKFDSVHSKYMGRTSFDSDSWTLRLHNLQIKDKGLYQCIIHHKKPTGMIRIHHMNSELS

SEQ ID NO: 225 - protein, 19 aa, Homo sapiens
  MISC_FEATURE: VH signal peptide
MGSTAILALLLAVLQGVSA

SEQ ID NO: 226 - protein, 232 aa, Homo sapiens
  MISC_FEATURE: IgG1 Fc
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 227 - protein, 235 aa, Homo sapiens
  MISC_FEATURE: IgG2 Fc
TKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 228 - protein, 15 aa, Artificial Sequence
  IgV-IgV linker
GGGGSGGGGSGGGGS

SEQ ID NO: 229 - protein, 10 aa, Artificial Sequence
  IgV-Fc linker 1
GGGGSGGGGS

SEQ ID NO: 230 - protein, 13 aa, Artificial Sequence
  IgV-Fc linker 2
GGGGSGGGGSAAA

SEQ ID NO: 231 - protein, 15 aa, Artificial Sequence
  CD80 WT linker 1
KADFPTPSISDFEIP

SEQ ID NO: 232 - protein, 10 aa, Artificial Sequence
  CD80 WT linker 2
TTKQEHFPDN

SEQ ID NO: 233 - protein, 11 aa, Artificial Sequence
  ICOSL WT linker 1
VTLHVAANFSV

SEQ ID NO: 234 - protein, 29 aa, Artificial Sequence
  ICOSL WT linker 2
VGSQTGNDIGERDKITENPVSTGEKNAAT

SEQ ID NO: 235 - protein, 9 aa, Artificial Sequence
  NKp30 WT linker 1
VEKEHPQLG

SEQ ID NO: 236 - protein, 9 aa, Artificial Sequence
  CD86 WT linker 1
APLKIQAYF

SEQ ID NO: 237 - protein, 18 aa, Artificial Sequence
  CD86 WT linker 2
VLANFSQPEIVPISNITE

SEQ ID NO: 238 - protein, 22 aa, Artificial Sequence
  CD86 WT linker 3
RLLSSPFSIELEDPQPPPDHIP

SEQ ID NO: 239 - protein, 238 aa, Artificial Sequence
  ICOSL v35 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 240 - protein, 111 aa, Artificial Sequence
  ICOSL v35 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVE

SEQ ID NO: 241 - protein, 254 aa, Artificial Sequence
  CD80-TIP I67T/L70Q/A91G/T120S
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEIPSSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 242 - DNA, 867 bp, Artificial Sequence
  CD80-TIP I67T/L70Q/A91G/T120S
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccacagtgatccaagctctgcgcccatctgacgagggcacatacgagtgtgttgttctgaagtatgaaaaagacggcttcaagcgggaacacctggctgaagtgacgttatcagtcaaagctgacttccctacacctagtatatctgactttgaaattccatcttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataa

SEQ ID NO: 243 - protein, 284 aa, Artificial Sequence
  ICOSL-TIP N52H/I143T
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTCTSTNGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 244 - DNA, 909 bp, Artificial Sequence
  ICOSL-TIP N52H/I143T
atgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccaccaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttga

SEQ ID NO: 245 - protein, 248 aa, Artificial Sequence
  Anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAA

SEQ ID NO: 246 - protein, 71 aa, Artificial Sequence
  CD8-derived hinge and transmembrane domain
KPTTTPAPRPPTPAPTIASQPLSLRPEASRPAAGGAVHTRGLDFASDIYIWAPLAGTCGVLLLSLVITLYC

SEQ ID NO: 247 - protein, 112 aa, Artificial Sequence
  CD3zeta intracellular signaling domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 248 - DNA, 1356 bp, Artificial Sequence
  AntiCD19x8z chimeric antigen receptor
  misc_feature: antiCD19x8z chimeric antigen receptor nucleotide
atggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggactaagttggaaataacaggctccacctctggatccggcaagcccggatctggcgagggatccaccaagggcgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcagcggccgcaaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 249 - DNA, 63 bp, Artificial Sequence
  T2A
ggcagtggcgagggcagaggaagtctgctaacatgcggtgacgtcgaggagaatcctggccca

SEQ ID NO: 250 - protein, 21 aa, Artificial Sequence
  T2A
GSGEGRGSLLTCGDVEENPGP

SEQ ID NO: 251 - DNA, 867 bp, Homo sapiens
  misc_feature: CD80
atgggccacacacggaggcagggaacatcaccatccaagtgtccatacctcaatttctttcagctcttggtgctggctggtctttctcacttctgttcaggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaagctgacttccctacacctagtatatctgactttgaaattccaacttctaatattagaaggataatttgctcaacctctggaggttttccagagcctcacctctcctggttggaaaatggagaagaattaaatgccatcaacacaacagtttcccaagatcctgaaactgagctctatgctgttagcagcaaactggatttcaatatgacaaccaaccacagcttcatgtgtctcatcaagtatggacatttaagagtgaatcagaccttcaactggaatacaaccaagcaagagcattttcctgataacctgctcccatcctgggccattaccttaatctcagtaaatggaatttttgtgatatgctgcctgacctactgctttgccccaagatgcagagagagaaggaggaatgagagattgagaagggaaagtgtacgccctgtataa

SEQ ID NO: 252 - DNA, 909 bp, Homo sapiens
  misc_feature: ICOSL
atgcggctgggcagtcctggactgctcttcctgctcttcagcagccttcgagctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagaacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgcccgtcgtcagcgccccccacagcccctcccaggatgagctcaccttcacgtgtacatccataaacggctaccccaggcccaacgtgtactggatcaataagacggacaacagcctgctggaccaggctctgcagaatgacaccgtcttcttgaacatgcggggcttgtatgacgtggtcagcgtgctgaggatcgcacggacccccagcgtgaacattggctgctgcatagagaacgtgcttctgcagcagaacctgactgtcggcagccagacaggaaatgacatcggagagagagacaagatcacagagaatccagtcagtaccggcgagaaaaacgcggccacgtggagcatcctggctgtcctgtgcctgcttgtggtcgtggcggtggccataggctgggtgtgcagggaccgatgcctccaacacagctatgcaggtgcctgggctgtgagtccggagacagagctcactggccacgtttga

SEQ ID NO: 253 - protein, 254 aa, Homo sapiens
  MISC_FEATURE: Mature CD80(B7-1)
VIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 254 - protein, 306 aa, Homo sapiens
  MISC_FEATURE: Mature CD86(B7-2)
APLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 255 - protein, 272 aa, Homo sapiens
  MISC_FEATURE: Mature CD274 (PD-L1, B7-H1)
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 256 - protein, 254 aa, Homo sapiens
  MISC_FEATURE: Mature PDCD1LG2(PD-L2, CD273)
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 257 - protein, 284 aa, Homo sapiens
  MISC_FEATURE: Mature ICOSLG(B7RP1, CD275, ICOSL, B7-H2)
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 258 - protein, 506 aa, Homo sapiens
  MISC_FEATURE: Mature CD276(B7-H3)
LEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 259 - protein, 258 aa, Homo sapiens
  MISC_FEATURE: Mature VTCN1(B7-H4)
LIIGFGISGRHSITVTTVASAGNIGEDGILSCTFEPDIKLSDIVIQWLKEGVLGLVHEFKEGKDELSEQDEMFRGRTAVFADQVIVGNASLRLKNVQLTDAGTYKCYIITSKGKGNANLEYKTGAFSMPEVNVDYNASSETLRCEAPRWFPQPTVVWASQVDQGANFSEVSNTSFELNSENVTMKVVSVLYNVTINNTYSCMIENDIAKATGDIKVTESEIKRRSHLQLLNSKASLCVSSFFAISWALLPLSPYLMLK

SEQ ID NO: 260 - protein, 202 aa, Homo sapiens
  MISC_FEATURE: Mature CD28
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 261 - protein, 188 aa, Homo sapiens
  MISC_FEATURE: Mature CTLA4
KAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 262 - protein, 268 aa, Homo sapiens
  MISC_FEATURE: Mature PDCD1(PD-1)
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 263 - protein, 179 aa, Homo sapiens
  MISC_FEATURE: Mature ICOS
EINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 264 - protein, 259 aa, Homo sapiens
  MISC_FEATURE: Mature BTLA(CD272)
KESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 265 - protein, 433 aa, Homo sapiens
  MISC_FEATURE: Mature CD4
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 266 - protein, 214 aa, Homo sapiens
  MISC_FEATURE: Mature CD8A(CD8-alpha)
SQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 267 - protein, 189 aa, Homo sapiens
  MISC_FEATURE: Mature CD8B(CD8-beta)
LQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 268 - protein, 497 aa, Homo sapiens
  MISC_FEATURE: Mature LAG3
VPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 269 - protein, 280 aa, Homo sapiens
  MISC_FEATURE: Mature HAVCR2(TIM-3)
SEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 270 - protein, 492 aa, Homo sapiens
  MISC_FEATURE: Mature CEACAM1
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 271 - protein, 222 aa, Homo sapiens
  MISC_FEATURE: Mature TIGIT
MTGTIETTGNISAEKGGSIILQCHLSSTTAQVTQVNWEQQDQLLAICNADLGWHISPSFKDRVAPGPGLGLTLQSLTVNDTGEYFCIYHTYPDGTYTGRIFLEVLESSVAEHGARFQIPLLGAMAATLVVICTAVIVVVALTRKKKALRIHSVEGDLRRKSAGQEEWSPSAPSPPGSCVQAEAAPAGLCGEQRGEDCAELHDYFNVLSYRSLGNCSFFTETG

SEQ ID NO: 272 - protein, 397 aa, Homo sapiens
  MISC_FEATURE: Mature PVR(CD155)
WPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 273 - protein, 507 aa, Homo sapiens
  MISC_FEATURE: Mature PVRL2(CD112)
QDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 274 - protein, 318 aa, Homo sapiens
  MISC_FEATURE: Mature CD226
EEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 275 - protein, 327 aa, Homo sapiens
  MISC_FEATURE: Mature CD2
KEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 276 - protein, 154 aa, Homo sapiens
  MISC_FEATURE: Mature CD160
INITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQA

SEQ ID NO: 277 - protein, 248 aa, Homo sapiens
  MISC_FEATURE: Mature CD200
QVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 278 - protein, 297 aa, Homo sapiens
  MISC_FEATURE: Mature CD200R1(CD200R)
MDEKQITQNYSKVLAEVNTSWPVKMATNAVLCCPPIALRNLIIITWEIILRGQPSCTKAYRKETNETKETNCTDERITWVSRPDQNSDLQIRPVAITHDGYYRCIMVTPDGNFHRGYHLQVLVTPEVTLFQNRNRTAVCKAVAGKPAAQISWIPEGDCATKQEYWSNGTVTVKSTCHWEVHNVSTVTCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 279 - protein, 183 aa, Homo sapiens
  MISC_FEATURE: Mature NC R3 (NKp30)
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 280 - protein, 238 aa, Artificial Sequence
  ICOSL v36 ECD
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 281 - protein, 238 aa, Artificial Sequence
  ICOSL v37 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 282 - protein, 238 aa, Artificial Sequence
  ICOSL v38 ECD
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 283 - protein, 238 aa, Artificial Sequence
  ICOSL v39 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 284 - protein, 238 aa, Artificial Sequence
  ICOSL v40 ECD
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 285 - protein, 238 aa, Artificial Sequence
  ICOSL v41 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 286 - protein, 238 aa, Artificial Sequence
  ICOSL v42 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFGVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 287 - protein, 238 aa, Artificial Sequence
  ICOSL v43 ECD
DTQEKEVRAMVGSDVELSCVCPEGSRFDLNDVYVYWQTSESKTVVTYHIPQHSSLEYVDSRYRNRALMSPAGMLRGDFSLRLFNVTPQDEQKFHCLVLSRSLGFQEVLGVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 288 - protein, 238 aa, Artificial Sequence; identical to SEQ ID NO: 113
  ICOSL v44 ECD

SEQ ID NO: 289 - protein, 238 aa, Artificial Sequence
  ICOSL v45 ECD
DTQEKEVRAMVGSDVELSCACPEGSRFDLNDVYVYWQTSESKTVVTYHIPQHSSLEYVDSSYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFSNMRGLYDVVSVLRIARTPSVNIGCCIENVLLQQNLTVGSQTGNDIGERDKITENPVSTGEKNAAT

SEQ ID NO: 290 - protein, 238 aa, Artificial Sequence
  ICOSL v46 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSAPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 291 - protein, 238 aa, Artificial Sequence
  ICOSL v47 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 292 - protein, 238 aa, Artificial Sequence
  ICOSL v48 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 293 - protein, 238 aa, Artificial Sequence
  ICOSL v49 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 294 - protein, 238 aa, Artificial Sequence
  ICOSL v50 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLALSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 295 - protein, 238 aa, Artificial Sequence
  ICOSL v51 ECD
DTQEKEVRAMVGSDVELSCACPEGSRFDLNDVYVYWQTSESKTVVTYHIPQSSSLENVDSRYRNRALMSPARMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 296 - protein, 238 aa, Artificial Sequence
  ICOSL v52 ECD
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVEVTLHVTANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 297 - protein, 238 aa, Artificial Sequence
  ICOSL v53 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGGRDKITENPVSTGEKNAAT

SEQ ID NO: 298 - protein, 238 aa, Artificial Sequence
  ICOSL v54 ECD
DTQEKEVRAMVGSDVELSCACPEGSRFDLNDVYVYWQTSESKTVVTHHIPQSSSLENVDSRYRNRALMSPAGMLRGDFSLRLFNVTPQDEQKFHCLVLSQSLGFQEALSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 299 - protein, 238 aa, Artificial Sequence
  ICOSL v55 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPFQDELTFTCTSINGYPRPNVYWINKTDNSLLDQALQNDTVFLNTRGLYDVVSVLRIARTPSVNIGCCIENVLLQQNLTVGSQTGNDIGERDKITENPVSTGEKNAAT

SEQ ID NO: 300 - protein, 238 aa, Artificial Sequence
  ICOSL v56 ECD
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAAT

SEQ ID NO: 301 - protein, 238 aa, Artificial Sequence
  ICOSL v57 ECD
DTQEKEVRAMVGSDVELSCACPEGSRFDLNDVYVYWRTSESKTVVTYHIPQHSSLEYVDSRYRNRALMSPAGMLRGDFSLRLFNVTPQDEQKFHCLVLSRSLGFQEVLSNEVTLHVAANFSVPVVSAPHSPSQDELTFTCTFINGYPRPNVYWINKTDNSLLDQALQNDTVFLNMRGLYDVVSVLRIARTPSVNIGCRIENVLLQQNLTVGSQTGNVIGEGDKITENPVSTGEKNAAT

SEQ ID NO: 302 - protein, 238 aa, Artificial Sequence
  ICOSL v58 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 303 - protein, 238 aa, Artificial Sequence
  ICOSL v59 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHAAANFSVPVVSAPHSPSQDELTFTCTSINGYPRPNVYWINKTDNSMLDQALQNDTVSLNMRGLYDVVSVLRIARTPGVNIGCRIENVLLQQNLTVGSQTGNDIGERDKITENPVSTGEKNAAT

SEQ ID NO: 304 - protein, 238 aa, Artificial Sequence
  ICOSL v60 ECD
DTQEKEVRAMVGSDVELSCACPEGSRSDLNDVYVYWQTSESKTVVTYHIPQHSSLEYVDSRYRNRALMSPAGMLRGDFSLRLFNVTPQDEQKFHCLVLSQSLGFQEVLSNEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 305 - protein, 238 aa, Artificial Sequence
  ICOSL v61 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLNVEVTLHVAANFSVPVVSAPHSPSQDELTFTCTSINGYPRPNVYWINKTDNSLLDQAQQNDTVFLNMRGLYDVVSVLRIARTPSVNIGCCIENVLLQQNLTVGSQTGNDIGERDKITENPVSTGEKNAAT

SEQ ID NO: 306 - protein, 238 aa, Artificial Sequence
  ICOSL v62 ECD
DTQEKEVRAMVGSDVELRCACPEGSRFDLNDVYVYWQTSESKTVVTYHIPQSSSLENVDSRYRNRALMSPAGMLRGDFSLRLFNVTPQDEQKLHCLVLSQSLGFQEVLSVEVTLHVAANFSVPVVSAPHSPSQDELTFTCTSVNGYPRPNVYWINKTDNSLLDQALQNDTVFLNMRGLYDVVSVLRIARTPSVNIGCCIENVLLQQNLTVGSQTGNDIGEGDKITENPVSTGEKNAAT

SEQ ID NO: 307 - protein, 238 aa, Artificial Sequence
  ICOSL v63 ECD
DTQEKEVRAMVGSDVELSCTCPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGCPRPNVYWINKTDNSLLDLALQNDTVFLNMRGLYDVVSVLRIARTPSVNIGCCIENVLLQQNLTVGSQTGNDIGERDKITENPVSTGEKNAAT

SEQ ID NO: 308 - protein, 238 aa, Artificial Sequence
  ICOSL v64 ECD
DTQEKEVRAMEGSDVELSCACPEGSRFDLDDVYVYWQTSESKTVVTYHIPQHSSLEYVDSRYRNRALMSPAGMLRGDFSLRLFNVTPQDEQKFECIVFSQSLGFQEVLSVEVTLHVAANFSVPVVSAPHSPSQDELTFTCTSINGYPRPNVYWINKTDNSLLDQALQNDTVFLNMRGLYDVVSVLRIARTPSVDIGCCIENVLLQQNLTAGSQTGNDTGERDKITENPVSTGEKNAAT

SEQ ID NO: 309 - protein, 238 aa, Artificial Sequence
  ICOSL v65 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLSVEVTLHVAANFSMPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 310 - protein, 238 aa, Artificial Sequence
  ICOSL v66 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFECIVLSQSLGFQEVLSVEVTLHVAANISVPVVTAPHSPSQDELTFTCTSINGYPRPNVYRINKTDNSLLDQALQNDTVFLNMRGLYDVVSVLRIARTPSVNIGCCIENVLLQQNLTVGSQTGNDNGERDKITENPVSTGEKNAAT

SEQ ID NO: 311 - protein, 238 aa, Artificial Sequence
  ICOSL v67 ECD
DTQEKEVRAVVGSDVELRCACPEGSRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVRAPHSPSQDELTFSCTSINGYPRPNVYWINKTDNSLLDQALQNDTVFLNMRGLYDVVSVLRIARTPSVNIGCCIENVFLQQNLTVGSQTGNDIGERDKITENPVSTGEKNAAT

SEQ ID NO: 312 - protein, 238 aa, Artificial Sequence
  ICOSL v68 ECD
DTQEKEVRAMVGSDVELSCACPEGGRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITEKPVSTGEKNAAT

SEQ ID NO: 313 - protein, 238 aa, Artificial Sequence
  ICOSL v69 ECD
DTQEKEVRAMVGSDVELSCACPEGSRFDLDDVYVYWQTSESKTVVTYHIPQSSSLENVDSRYRNRAPMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNGIGEKDKISENPVSTGEKNAAT

SEQ ID NO: 314 - protein, 238 aa, Artificial Sequence
  ICOSL v70 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVTANFSVPVVSAPHSPSQDELTFTCTSINGYPRPNVYWINKTDNSLLDQALQNDTVFLNMRGLYDVVSVLRIARSPSVNIGCRIENVLLQQNLTVGSQTGNDIGERDKITENPVSTGEKNAAT

SEQ ID NO: 315 - protein, 238 aa, Artificial Sequence
  ICOSL v71 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 316 - protein, 238 aa, Artificial Sequence
  ICOSL v72 ECD
DTQEKEVRAMVGSDVELSCACPEGGRCDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDKLTFTCTSINGYPRPNVYWINKTDNSLLDQALQNDTVFSNMRGLYDVVSVLRIARTPSVNIGCRIENVLLQQNLTVGSQTGNDIGERDKITENPVSTGEKNAAT

SEQ ID NO: 317 - protein, 238 aa, Artificial Sequence
  ICOSL v73 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSAEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGEIDKITENPVSTGEKNAAT

SEQ ID NO: 318 - protein, 238 aa, Artificial Sequence
  ICOSL v74 ECD
DTQEKEVRAIVGGDVELSCACPEGSRFDLNDVYVYWQTSESKTVVTYHIPQHSSLEYVDSRYRNRALMSPAGMLRGGFSLRLFNVTPQDEQKFHCLVLSQSLGFQEVLSAEVTLHVAANFSVPVVSAPPSPSQDELTFTCTSVNGYPRPNVYWINKTDNSLLDQALQNDTVSLNMRGLYDVVSVLRIARTPSMNIGCRIENVLLQQNLTVGSQTGNDIGERDKITENPVSTGEKNAAT

SEQ ID NO: 319 - protein, 238 aa, Artificial Sequence
  ICOSL v75 ECD
DTQEKEVRAMVGSDVELSCACPEGSRFDLNDVYVYWQTSESKTVVTYHIPQHSSLEYVDSCFRNRALMSPAGMLRGDFSLRLFNVTPQDEQKFHCLVLSRSLGFQEVLSNEVTLHVAANSSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 320 - protein, 238 aa, Artificial Sequence
  ICOSL v76 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 321 - protein, 238 aa, Artificial Sequence
  ICOSL v77 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSIDGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 322 - protein, 238 aa, Artificial Sequence
  ICOSL v78 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECLVFSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 323 - protein, 238 aa, Artificial Sequence
  ICOSL v79 ECD
DTQEKEVRAMVGSDVELSCACPEGSRFDLNDVYVYWQTSESKTVVTYHIPQSSSLENVDSRYRNRALMSPAGMLRGDFSLRLFNVTPQDAQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 324 - protein, 238 aa, Artificial Sequence
  ICOSL v80 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 325 - protein, 238 aa, Artificial Sequence
  ICOSL v81 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSVNGYPRPNVYWINKTDNSLLDQALQNDTVFLNMRGLYDVVSVLRIARTPSVNIGCCIENVLLQQNLTVGSQTGNDIGERDKVTENPVSTGEKNAAT

SEQ ID NO: 326 - protein, 111 aa, Artificial Sequence
  ICOSL v36 IgV
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVE

SEQ ID NO: 327 - protein, 111 aa, Artificial Sequence
  ICOSL v37  IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDE

SEQ ID NO: 328 - protein, 111 aa, Artificial Sequence
  ICOSL v38  IgV
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSRSLGFQEVLSDE

SEQ ID NO: 329 - protein, 111 aa, Artificial Sequence
  ICOSL v39  IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVE

SEQ ID NO: 330 - protein, 111 aa, Artificial Sequence
  ICOSL v40  IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSRSLGFQEVLSDE

SEQ ID NO: 331 - protein, 111 aa, Artificial Sequence
  ICOSL v41  IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVE

SEQ ID NO: 332 - protein, 111 aa, Artificial Sequence
  ICOSL v43  IgV
DTQEKEVRAMVGSDVELSCVCPEGSRFDLNDVYVYWQTSESKTVVTYHIPQHSSLEYVDSRYRNRALMSPAGMLRGDFSLRLFNVTPQDEQKFHCLVLSRSLGFQEVLGVE

SEQ ID NO: 333 - protein, 111 aa, Artificial Sequence; identical to SEQ ID NO: 201
  ICOSL v44  IgV

SEQ ID NO: 334 - protein, 111 aa, Artificial Sequence
  ICOSL v48 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVE

SEQ ID NO: 335 - protein, 111 aa, Artificial Sequence
  ICOSL v50 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLALSQSLGFQEVLSVE

SEQ ID NO: 336 - protein, 111 aa, Artificial Sequence
  ICOSL v51  IgV
DTQEKEVRAMVGSDVELSCACPEGSRFDLNDVYVYWQTSESKTVVTYHIPQSSSLENVDSRYRNRALMSPARMLRGDFSLRLFNVTPQDEQKFHCLVLSQSLGFQEVLSVE

SEQ ID NO: 337 - protein, 111 aa, Artificial Sequence
  ICOSL v60  IgV
DTQEKEVRAMVGSDVELSCACPEGSRSDLNDVYVYWQTSESKTVVTYHIPQHSSLEYVDSRYRNRALMSPAGMLRGDFSLRLFNVTPQDEQKFHCLVLSQSLGFQEVLSNE

SEQ ID NO: 338 - protein, 111 aa, Artificial Sequence
  ICOSL v78  IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECLVFSRSLGFQEVLSVE

SEQ ID NO: 339 - protein, 111 aa, Artificial Sequence
  ICOSL v79 IgV
DTQEKEVRAMVGSDVELSCACPEGSRFDLNDVYVYWQTSESKTVVTYHIPQSSSLENVDSRYRNRALMSPAGMLRGDFSLRLFNVTPQDAQKFHCLVLSQSLGFQEVLSVE

SEQ ID NO: 340 - protein, 111 aa, Artificial Sequence
  ICOSL v80  IgV
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVE

SEQ ID NO: 341 - protein, 414 aa, Homo sapiens
  MISC_FEATURE: VSIG8
MRVGGAFHLLLVCLSPALLSAVRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 342 - protein, 393 aa, Homo sapiens
  MISC_FEATURE: Mature VSIG8
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIGVIIGIVLGSLLALGCLAVGIWGLVCCCCGGSGAGGARGAFGYGNGGGVGGGACGDLASEIREDAVAPGCKASGRGSRVTHLLGYPTQNVSRSLRRKYAPPPCGGPEDVALAPCTAAAACEAGPSPVYVKVKSAEPADCAEGPVQCKNGLLV

SEQ ID NO: 343 - protein, 242 aa, Homo sapiens
  MISC_FEATURE: VSIG8 ECD
VRINGDGQEVLYLAEGDNVRLGCPYVLDPEDYGPNGLDIEWMQVNSDPAHHRENVFLSYQDKRINHGSLPHLQQRVRFAASDPSQYDASINLMNLQVSDTATYECRVKKTTMATRKVIVTVQARPAVPMCWTEGHMTYGNDVVLKCYASGGSQPLSYKWAKISGHHYPYRAGSYTSQHSYHSELSYQESFHSSINQGLNNGDLVLKDISRADDGLYQCTVANNVGYSVCVVEVKVSDSRRIG

SEQ ID NO: 344 - protein, 16 aa, Artificial Sequence
  CD33 Signal Peptide
MPLLLLLPLLWAGALA

SEQ ID NO: 345 - protein, 22 aa, Artificial Sequence
  IgGkappa light chain
MDMRVLAQLLGLLLLCFPGARC

SEQ ID NO: 346 - protein, 18 aa, Artificial Sequence
  HSA signal peptide
MKWVTFISLLFLFSSAYS

SEQ ID NO: 347 - protein, 22 aa, Artificial Sequence
  Ig kappa light chain
MDMRAPAGIFGFLLVLFPGYRS

SEQ ID NO: 348 - protein, 19 aa, Artificial Sequence
  Human azurocidin preprotein signal sequence
MTRLTVLALLAGLLASSRA

SEQ ID NO: 349 - protein, 19 aa, Artificial Sequence
  IgG heavy chain signal peptide
MELGLSWIFLLAILKGVQC

SEQ ID NO: 350 - protein, 19 aa, Artificial Sequence
  IgG heavy chain signal peptide
MELGLRWVFLVAILEGVQC

SEQ ID NO: 351 - protein, 19 aa, Artificial Sequence
  IgG heavy chain signal peptide
MKHLWFFLLLVAAPRWVLS

SEQ ID NO: 352 - protein, 19 aa, Artificial Sequence
  IgG heavy chain signal peptide
MDWTWRILFLVAAATGAHS

SEQ ID NO: 353 - protein, 19 aa, Artificial Sequence
  IgG heavy chain signal peptide
MDWTWRFLFVVAAATGVQS

SEQ ID NO: 354 - protein, 19 aa, Artificial Sequence
  IgG heavy chain signal peptide
MEFGLSWLFLVAILKGVQC

SEQ ID NO: 355 - protein, 19 aa, Artificial Sequence
  IgG heavy chain signal peptide
MEFGLSWVFLVALFRGVQC

SEQ ID NO: 356 - protein, 26 aa, Artificial Sequence
  IgG heavy chain signal peptide
MDLLHKNMKHLWFFLLLVAAPRWVLS

SEQ ID NO: 357 - protein, 22 aa, Artificial Sequence
  IgG Kappa light chain signal sequences
MDMRVPAQLLGLLLLWLSGARC

SEQ ID NO: 358 - protein, 22 aa, Artificial Sequence
  IgG Kappa light chain signal sequences
MKYLLPTAAAGLLLLAAQPAMA

SEQ ID NO: 359 - protein, 17 aa, Artificial Sequence
  Gaussia luciferase
MGVKVLFALICIAVAEA

SEQ ID NO: 360 - protein, 18 aa, Artificial Sequence
  Human albumin
MKWVTFISLLFLFSSAYS

SEQ ID NO: 361 - protein, 18 aa, Artificial Sequence
  Human chymotrypsinogen
MAFLWLLSCWALLGTTFG

SEQ ID NO: 362 - protein, 14 aa, Artificial Sequence
  Human interleukin-2
MQLLSCIALILALV

SEQ ID NO: 363 - protein, 15 aa, Artificial Sequence
  Human trypsinogen-2
MNLLLILTFVAAAVA

SEQ ID NO: 364 - protein, 238 aa, Artificial Sequence
  ICOSL v81 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGGQTGNDIGERDKITENPVSTGEKNAAT

SEQ ID NO: 365 - protein, 238 aa, Artificial Sequence
  ICOSL v82 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 366 - protein, 238 aa, Artificial Sequence
  ICOSL v83 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVDIGCCIENVLLQQNLTVGSQTGNDIGERDKITENPVSTGEKNAAT

SEQ ID NO: 367 - protein, 238 aa, Artificial Sequence
  ICOSL v84 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSDEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 368 - protein, 238 aa, Artificial Sequence
  ICOSL v85 ECD
DTQEKEVRAMVGSDVELSCACPEGSRFDLNDVYVYWQTSESKTVVTYHIPQSSPLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 369 - protein, 238 aa, Artificial Sequence
  ICOSL v86 ECD
DTQEKEVRAMVGSDVELSCACPEGSRFDLNDVYVYWQPSESKTVVTYHIPQSSSLEDVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 370 - protein, 237 aa, Artificial Sequence
  ICOSL v87 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 371 - protein, 237 aa, Artificial Sequence
  ICOSL v88 ECD
DTQEKEVRAMVGSDVELSCACPEGSRFDLNDVVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 372 - protein, 237 aa, Artificial Sequence
  ICOSL v89 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSVPVVSAPHSPSQDELTFTTSINGYPRPNVYWINKTDNSLLDQALQNDTVFLNMRGLYDVVSVLRIARTPSVNIGCCIENVLLQQNLTVGSQTGNDIGERDKIAENPVSTGEKNAAT

SEQ ID NO: 373 - protein, 238 aa, Artificial Sequence
  ICOSL v90 ECD
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 374 - protein, 238 aa, Artificial Sequence
  ICOSL v91  ECD
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSPSLGFQEVLSDEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 375 - protein, 238 aa, Artificial Sequence
  ICOSL v92 ECD
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSQSLGFQEVLSDEVTLHVAANFSVPVVSAPHSPSQDELTFTCTSINGYPRPNVYWINKTDNSLLDQALQNDTVFLNMRGLYDVVSVLRIARTPGVNIGCCIENVLLQQNLTVGSQTGNDIGERDKITENPVSTGEKNAAT

SEQ ID NO: 376 - protein, 238 aa, Artificial Sequence
  ICOSL v93 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFGVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 377 - protein, 238 aa, Artificial Sequence
  ICOSL v94 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITEKPVSTGEKNAAT

SEQ ID NO: 378 - protein, 238 aa, Artificial Sequence
  ICOSL v96 ECD
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVEVTLHVTANFSVPVVSAPHSPSQDELTFTCTSINGYPRPNVYWINKTDNSLLDQALQNDTVFLNMRGLYDVVSVLRIARAPSVNIGCRIENVLLQQNLTVGSQTGNDIGERDKITENPVSTGEKNAAT

SEQ ID NO: 379 - protein, 238 aa, Artificial Sequence
  ICOSL v96 ECD
DTQEKEVRAMVGSDVELSCACPEGSRFDLNDVYVYWQTSESKAVVTYHIPQHSSLEYVDSRYRNRALMSPAGMQRGDFSLRLFNVTPQGEQKFHCLVLSQSLGFQEVLSDEVTLHVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 380 - protein, 238 aa, Artificial Sequence; identical to SEQ ID NO: 299
  ICOSL v97 ECD

SEQ ID NO: 381 - protein, 238 aa, Artificial Sequence
  ICOSL v98 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEILSDEVTLHVAANFSVPVVSAPHSPSQDELTFTCTSINGYPRPNVYWFNKTDNSLLDQALQNDTVFLNMRGLYDVVSVLRIARTPSVNIGCRIENVLLQQNLTVGSQTGNDIGEGDKITENPVSTGEKNAAT

SEQ ID NO: 382 - protein, 111 aa, Artificial Sequence
  ICOSL v85  IgV
DTQEKEVRAMVGSDVELSCACPEGSRFDLNDVYVYWQTSESKTVVTYHIPQSSPLENVDSRYRNRALMSPAGMLRGDFSLRLFNVTPQDEQKFHCLVLSQSLGFQEVLSVE

SEQ ID NO: 383 - protein, 111 aa, Artificial Sequence
  ICOSL v86  IgV
DTQEKEVRAMVGSDVELSCACPEGSRFDLNDVYVYWQPSESKTVVTYHIPQSSSLEDVDSRYRNRALMSPAGMLRGDFSLRLFNVTPQDEQKFHCLVLSQSLGFQEVLSVE

SEQ ID NO: 384 - protein, 110 aa, Artificial Sequence
  ICOSL v87  IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSV

SEQ ID NO: 385 - protein, 110 aa, Artificial Sequence
  ICOSL v88  IgV
DTQEKEVRAMVGSDVELSCACPEGSRFDLNDVVYWQTSESKTVVTYHIPQNSSLENVDSRYRNRALMSPAGMLRGDFSLRLFNVTPQDEQKFHCLVLSQSLGFQEVLSVE

SEQ ID NO: 386 - protein, 111 aa, Artificial Sequence
  ICOSL v91  IgV
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSPSLGFQEVLSDE

SEQ ID NO: 387 - protein, 238 aa, Artificial Sequence
  ICOSL v99 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 388 - protein, 238 aa, Artificial Sequence
  ICOSL v100 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 389 - protein, 238 aa, Artificial Sequence
  ICOSL v101 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 390 - protein, 238 aa, Artificial Sequence
  ICOSL v102 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 391 - protein, 238 aa, Artificial Sequence
  ICOSL v103 ECD
  VARIANT (207)..(207): X = N or Q
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQXLTVGSQTGNDIGERDKITENPVSTGEKNAAT

SEQ ID NO: 392 - protein, 238 aa, Artificial Sequence
  ICOSL v104 ECD
  VARIANT (168)..(168): X = N or Q
  VARIANT (207)..(207): X = N or Q
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQXDTVFLNMRGLYDVVSVLRIARTPSVNIGCCIENVLLQQXLTVGSQTGNDIGERDKITENPVSTGEKNAAT

SEQ ID NO: 393 - protein, 238 aa, Artificial Sequence
  ICOSL v105 ECD
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 394 - protein, 238 aa, Artificial Sequence
  ICOSL v106 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 395 - protein, 238 aa, Artificial Sequence
  ICOSL v107 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWIQKTDNSLLDQALQNDTVFLNMRGLYDVVSVLRIARTPSVNIGCCIENVLLQQQLTVGSQTGNDIGERDKITENPVSTGEKNAAT

SEQ ID NO: 396 - protein, 238 aa, Artificial Sequence
  ICOSL v108 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 397 - protein, 238 aa, Artificial Sequence
  ICOSL v109 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 398 - protein, 238 aa, Artificial Sequence
  ICOSL v110 ECD
  VARIANT (155)..(155): X = N or Q
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIXKTDNSLLDQALQNDTVFLNMRGLYDVVSVLRIARTPSVNIGCCIENVLLQQNLTVGSQTGNDIGERDKITENPVSTGEKNAAT

SEQ ID NO: 399 - protein, 238 aa, Artificial Sequence
  ICOSL v111 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 400 - protein, 238 aa, Artificial Sequence
  ICOSL v112 ECD
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 401 - protein, 238 aa, Artificial Sequence
  ICOSL v113 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 402 - protein, 238 aa, Artificial Sequence
  Artificial Sequence
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 403 - protein, 238 aa, Artificial Sequence
  ICOSL v115 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 404 - protein, 238 aa, Artificial Sequence
  ICOSL v116 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIQKTDNSLLDQALQQDTVFLNMRGLYDVVSVLRIARTPSVNIGCCIENVLLQQNLTVGSQTGNDIGERDKITENPVSTGEKNAAT

SEQ ID NO: 405 - protein, 238 aa, Artificial Sequence
  ICOSL v117 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQQDTVFLNMRGLYDVVSVLRIARTPSVNIGCCIENVLLQQQLTVGSQTGNDIGERDKITENPVSTGEKNAAT

SEQ ID NO: 406 - protein, 238 aa, Artificial Sequence
  ICOSL v118 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIHKTDNSLLDQALQNDTVFLNMRGLYDVVSVLRIARTPSVNIGCCIENVLLQQQLTVGSQTGNDIGERDKITENPVSTGEKNAAT

SEQ ID NO: 407 - protein, 238 aa, Artificial Sequence
  ICOSL v119 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWIQKTDNSLLDQALQQDTVFLNMRGLYDVVSVLRIARTPSVNIGCCIENVLLQQQLTVGSQTGNDIGERDKITENPVSTGEKNAAT

SEQ ID NO: 408 - protein, 238 aa, Artificial Sequence
  ICOSL v120 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIQKTDNSLLDQALQQDTVFLNMRGLYDVVSVLRIARTPSVNIGCCIENVLLQQNLTVGSQTGNDIGERDKITENPVSTGEKNAAT

SEQ ID NO: 409 - protein, 238 aa, Artificial Sequence
  ICOSL v121 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWINKTDNSLLDQALQQDTVFLNMRGLYDVVSVLRIARTPSVNIGCCIENVLLQQQLTVGSQTGNDIGERDKITENPVSTGEKNAAT

SEQ ID NO: 410 - protein, 238 aa, Artificial Sequence
  ICOSL v122 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 411 - protein, 238 aa, Artificial Sequence
  ICOSL v123 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIHKTDNSLLDQALQNDTVFLNMRGLYDVVSVLRIARTPSVNIGCCIENVLLQQQLTVGSQTGNDIGERDKITENPVSTGEKNAAT

SEQ ID NO: 412 - protein, 238 aa, Artificial Sequence
  ICOSL v124 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQNLTVGSQTGNDIGERDKITENPVSTGEKNAAT

SEQ ID NO: 413 - protein, 238 aa, Artificial Sequence
  ICOSL v125 ECD
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQNLTVGSQTGNDIGERDKITENPVSTGEKNAAT

SEQ ID NO: 414 - protein, 238 aa, Artificial Sequence
  ICOSL v126 ECD
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 415 - protein, 238 aa, Artificial Sequence
  ICOSL v127 ECD
  VARIANT (168)..(168): X = N or Q
  VARIANT (207)..(207): X = N or Q
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWINKTDNSLLDQALQXDTVFLNMRGLYDVVSVLRIARTPSVNIGCCIENVLLQQXLTVGSQTGNDIGERDKITENPVSTGEKNAAT

SEQ ID NO: 416 - protein, 238 aa, Artificial Sequence
  ICOSL v128 ECD
  VARIANT (155)..(155): X = N or Q
  VARIANT (168)..(168): X = N or Q
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIXKTDNSLLDQALQXDTVFLNMRGLYDVVSVLRIARTPSVNIGCCIENVLLQQNLTVGSQTGNDIGERDKITENPVSTGEKNAAT

SEQ ID NO: 417 - protein, 238 aa, Artificial Sequence
  ICOSL v129 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQQDTVFLNMRGLYDVVSVLRIARTPSVNIGCCIENVLLQQNLTVGSQTGNDIGERDKITENPVSTGEKNAAT

SEQ ID NO: 418 - protein, 238 aa, Artificial Sequence
  ICOSL v131 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQQDTVFLNMRGLYDVVSVLRIARTPSVNIGCCIENVLLQQNLTVGSQTGNDIGERDKITENPVSTGEKNAAT

SEQ ID NO: 419 - protein, 238 aa, Artificial Sequence
  ICOSL v131 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSVPVVSAPHSPSQDELTFTCTSINGYPRPNVYWIQKTDNSLLDQALQQDTVFLNMRGLYDVVSVLRIARTPSVNIGCCIENVLLQQQLTVGSQTGNDIGERDKITENPVSTGEKNAAT

SEQ ID NO: 420 - protein, 238 aa, Artificial Sequence
  ICOSL v132 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQQLTVGSQTGNDIGERDKITENPVSTGEKNAAT

SEQ ID NO: 421 - protein, 238 aa, Artificial Sequence
  ICOSL v133 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWINKTDNSLLDQALQNDTVFLNMRGLYDVVSVLRIARTPSVNIGCCIENVLLQQQLTVGSQTGNDIGERDKITENPVSTGEKNAAT

SEQ ID NO: 422 - protein, 238 aa, Artificial Sequence
  ICOSL v134 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQNLTVGSQTGNDIGERDKITENPVSTGEKNAAT

SEQ ID NO: 423 - protein, 238 aa, Artificial Sequence
  ICOSL v135 ECD
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQNDTVFLNMRGLYDVVSVLRIARTPSVNIGCCIENVLLQQQLTVGSQTGNDIGERDKITENPVSTGEKNAAT

SEQ ID NO: 424 - protein, 238 aa, Artificial Sequence
  ICOSL v136 ECD
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSVPVVSAPHSPSQDELTFTCTSINGYPRPNVYWIQKTDNSLLDQALQQDTVFLNMRGLYDVVSVLRIARTPSVNIGCCIENVLLQQQLTVGSQTGNDIGERDKITENPVSTGEKNAAT

SEQ ID NO: 425 - protein, 111 aa, Artificial Sequence
  ICOSL v99 IgV
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVE

SEQ ID NO: 426 - protein, 111 aa, Artificial Sequence
  ICOSL v111 IgV
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVE

SEQ ID NO: 427 - protein, 238 aa, Artificial Sequence
  ICOSL v137 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 428 - protein, 238 aa, Artificial Sequence
  ICOSL v138 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 429 - protein, 238 aa, Artificial Sequence
  ICOSL v139 ECD
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 430 - protein, 238 aa, Artificial Sequence
  ICOSL v140 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 431 - protein, 238 aa, Artificial Sequence
  ICOSL v141 ECD
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 432 - protein, 238 aa, Artificial Sequence
  ICOSL v142 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVEVTLHVAANFSVPVVSAPHSPSQDELTLTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 433 - protein, 238 aa, Artificial Sequence
  ICOSL v143 ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVPLQQNLTVGSQTGNDIGERDKITENPVSTGEKNAAT

SEQ ID NO: 434 - protein, 111 aa, Artificial Sequence
  ICOSL v137 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVE

SEQ ID NO: 435 - protein, 238 aa, Artificial Sequence
  ICOSL v144 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 436 - protein, 238 aa, Artificial Sequence
  ICOSL v145 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 437 - protein, 238 aa, Artificial Sequence
  ICOSL v146 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 438 - protein, 238 aa, Artificial Sequence
  ICOSL v147 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSVNGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 439 - protein, 238 aa, Artificial Sequence
  ICOSL v148 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 440 - protein, 238 aa, Artificial Sequence
  ICOSL v149 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSAPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 441 - protein, 238 aa, Artificial Sequence
  ICOSL v150 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVDIGCCIENVLLQQNLTVGSQTGNDIGERDKITENPVSTGEKNAAT

SEQ ID NO: 442 - protein, 238 aa, Artificial Sequence
  ICOSL v151 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 443 - protein, 238 aa, Artificial Sequence; identical to SEQ ID NO: 435
  ICOSL v152 ECD

SEQ ID NO: 444 - protein, 238 aa, Artificial Sequence
  ICOSL v153 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 445 - protein, 238 aa, Artificial Sequence
  ICOSL v154 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 446 - protein, 238 aa, Artificial Sequence
  ICOSL v155 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKVTENPVSTGEKNAAT

SEQ ID NO: 447 - protein, 238 aa, Artificial Sequence
  ICOSL v156 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 448 - protein, 238 aa, Artificial Sequence; identical to SEQ ID NO: 291
  ICOSL v157 ECD

SEQ ID NO: 449 - protein, 238 aa, Artificial Sequence
  ICOSL v158 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSVPVVSAPHSPSQDELTFTCTSTNGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 450 - protein, 238 aa, Artificial Sequence
  ICOSL v159 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 451 - protein, 238 aa, Artificial Sequence
  ICOSL v160 ECD
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 452 - protein, 238 aa, Artificial Sequence
  ICOSL v161 ECD
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 453 - protein, 238 aa, Artificial Sequence
  ICOSL v162 ECD
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVSLNMRGLYDVVSVLRIARTPSVNIGCRIENVLLQQNLTVGSQTGNDIGERDKITENPVSTGEKNAAT

SEQ ID NO: 454 - protein, 238 aa, Artificial Sequence
  ICOSL v163 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 455 - protein, 238 aa, Artificial Sequence; identical to SEQ ID NO: 454
  ICOSL v164 ECD

SEQ ID NO: 456 - protein, 238 aa, Artificial Sequence
  ICOSL v165 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGEIDKITENPVSTGEKNAAT

SEQ ID NO: 457 - protein, 238 aa, Artificial Sequence
  ICOSL v166 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 458 - protein, 238 aa, Artificial Sequence
  ICOSL v167 ECD
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVSLNMRGLYDVVSVLRIARTPSVDIGCCIENVLLQQNLTVGSQTGNDIGERDKITENPVSTGEKNAAT

SEQ ID NO: 459 - protein, 238 aa, Artificial Sequence
  ICOSL v168 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANSSVPVVSAPHSPSQDELTFTCTSVNGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 460 - protein, 238 aa, Artificial Sequence
  ICOSL v169 ECD
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 461 - protein, 238 aa, Artificial Sequence
  ICOSL v170 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 462 - protein, 238 aa, Artificial Sequence
  ICOSL v171 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 463 - protein, 238 aa, Artificial Sequence
  ICOSL v172 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 464 - protein, 238 aa, Artificial Sequence
  ICOSL v173 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 465 - protein, 238 aa, Artificial Sequence
  ICOSL v174 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 466 - protein, 238 aa, Artificial Sequence
  ICOSL v175 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 467 - protein, 238 aa, Artificial Sequence
  ICOSL v176 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCCIENVLLQQNLTVGSQTGNDIGERDKITENPVSTGEKNAAT

SEQ ID NO: 468 - protein, 238 aa, Artificial Sequence
  ICOSL v177 ECD
  VARIANT (115)..(115): X is H or Q
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLXVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 469 - protein, 238 aa, Artificial Sequence
  ICOSL v178 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSVPVVSAPHSPSQDELTFTCTSINGYPRPNVYWINKTDNSLLDQALQNDTVSLNMRGLYDVVSVLRIARTPSVNIGCRIENVLLQQNLTVGSQTGNDIGERDKITENPVSTGEKNAAT

SEQ ID NO: 470 - protein, 238 aa, Artificial Sequence; identical to SEQ ID NO: 436
  ICOSL v179 ECD

SEQ ID NO: 471 - protein, 18 aa, Artificial Sequence
  CD80 WT linker 1 (including first 3 aa)
LSVKADFPTPSISDFEIP

SEQ ID NO: 472 - protein, 232 aa, Artificial Sequence
  Knob Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 473 - protein, 232 aa, Artificial Sequence
  Hole Fc
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 474 - protein, 232 aa, Artificial Sequence
  Fc region
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 475 - protein, 8 aa, Artificial Sequence
  Stuffer
HMSSVSAQ

SEQ ID NO: 476 - protein, 232 aa, Artificial Sequence
  Fc (C5S (C220S), R77C, (R292C),  N82G (N297G), V87C (V302C))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 232 aa, Artificial Sequence
  Fc with C220S/L234A/L235E/G237A
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 478 - protein, 231 aa, artificial Sequence
  Fc with C220S/E233P/L234V/L235A/G236del/S267K
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 479 - protein, 431 aa, Artificial Sequence
  antiCD19z chimeric antigen receptor
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSAAAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 480 - protein, 21 aa, Artificial Sequence
  CD8-derived signal sequence
MALPVTALLLPLALLLHAARP

SEQ ID NO: 481 - protein, 23 aa, Artificial Sequence
  CD8-derived signal sequence
MALPVTALLLPLALLLHAARPGS

SEQ ID NO: 482 - protein, 245 aa, Artificial Sequence
  anti-CD19 scFv
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSS

SEQ ID NO: 483 - protein, 69 aa, Artificial Sequence
  CD8-derived hinge and transmembrane domain
AKPTTTPAPRPPTPAPTIASQPLSLRPEACRPAAGGAVHTRGLDFACDIYIWAPLAGTCGVLLLSLVIT

SEQ ID NO: 484 - protein, 42 aa, Artificial Sequence
  4-1BB-derived costimulatory domain
KRGRKKLLYIFKQPFMRPVQTTQEEDGCSCRFPEEEEGGCEL

SEQ ID NO: 485 - protein, 40 aa, Artificial Sequence
  CD28-derived costimulatory domain
SKRSRLLHSDYMNMTPRRPGPTRKHYQPYAPPRDFAAYRS

SEQ ID NO: 486 - protein, 41 aa, Artificial Sequence
  CD28-derived costimulatory domain
RSKRSRLLHSDYMNMTPRRPGPTRKHYQPYAPPRDFAAYRS

SEQ ID NO: 487 - protein, 44 aa, Artificial Sequence
  CD28-derived costimulatory domain
FWVRSKRSRLLHSDYMNMTPRRPGPTRKHYQPYAPPRDFAAYRS

SEQ ID NO: 488 - protein, 20 aa, Artificial Sequence
  T2A protein
SGEGRGSLLTCGDVEENPGP

SEQ ID NO: 489 - protein, 232 aa, Artificial Sequence
  Blue fluorescent protein
SELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 490 - protein, 472 aa, Artificial Sequence
  2nd Gen CAR (without signal sequence or T2A or BFP)
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 491 - protein, 497 aa, Artificial Sequence
  2nd Gen CAR with T2A
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSR

SEQ ID NO: 492 - protein, 471 aa, Artificial Sequence
  2nd Gen CAR with CD28-derived costimulatory domain (without signal sequence or T2A or BFP)
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITMHRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 493 - protein, 270 aa, Artificial Sequence
  Nkp30 stack
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGGSGGGGSAAAEPK

SEQ ID NO: 494 - protein, 302 aa, Artificial Sequence; identical to SEQ ID NO: 5
  TIP v1

SEQ ID NO: 495 - protein, 284 aa, Artificial Sequence; identical to SEQ ID NO: 257
  TIP v1 without Signal Peptide

SEQ ID NO: 496 - protein, 302 aa, Artificial Sequence
  TIP v2
MRLGSPGLLFLLFSSLRADTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 497 - protein, 284 aa, Artificial Sequence
  TIP v2 without Signal Peptide
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 498 - protein, 302 aa, Artificial Sequence
  TIP v3
MRLGSPGLLFLLFSSLRADTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 499 - protein, 284 aa, Artificial Sequence
  TIP v3 without Signal Peptide
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 500 - protein, 302 aa, Artificial Sequence
  TIP v4
MRLGSPGLLFLLFSSLRADTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAATWSILAVLCLLVVVAVAIGWVCRDRCLQHSYAGAWAVSPETELTGHV

SEQ ID NO: 501 - protein, 284 aa, Artificial Sequence
  TIP v4 without Signal Peptide
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAATWSILAVLCLLVVVAVAIGWVCRDRCLQHSYAGAWAVSPETELTGHV

SEQ ID NO: 502 - protein, 302 aa, Artificial Sequence
  TIP v5
MRLGSPGLLFLLFSSLRADTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 503 - protein, 284 aa, Artificial Sequence
  TIP v5 without Signal Peptide
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 504 - protein, 116 aa, Artificial Sequence
  NKp30 v1 IgV-like
LWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQL

SEQ ID NO: 505 - protein, 229 aa, Artificial Sequence
  IgG4 Fc
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 506 - protein, 229 aa, Artificial Sequence
  IgG4 Fc S228P
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 507 - protein, 232 aa, Artificial Sequence
  IgG1 Fc C220S
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 508 - protein, 208 aa, Artificial Sequence
  CD80 v55 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEIPTSNIRRIICSTSGGFPEPHLSWLEDGEELNAINTTVSQDPETELYAVSSKLDFNMTTNHSFMCLIKYGHLRVNQTFNWNTTKQEHFPDN

SEQ ID NO: 509 - protein, 208 aa, Artificial Sequence
  CD80 v56 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEAPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 510 - protein, 208 aa, Artificial Sequence
  CD80 v57 ECD
VIHMTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 511 - protein, 208 aa, Artificial Sequence
  CD80 v58 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 512 - protein, 208 aa, Artificial Sequence
  CD80 v59 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVSQTFNWNTTKQEHFPDN

SEQ ID NO: 513 - protein, 208 aa, Artificial Sequence
  CD80 v60 ECD
VIHVTKEVKEVATLSCGHNLSVEELAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 514 - protein, 208 aa, Artificial Sequence
  CD80 v61 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPTPSISDFGVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 515 - protein, 208 aa, Artificial Sequence
  CD80 v62 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 516 - protein, 208 aa, Artificial Sequence
  CD80 v63 ECD
VIHVTKEVKEVATLSCGHNVSVEELAQTRIYWQKEKKMVLTMMSGDMNIWPEYKNRTIFDITNNLSIVIRALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNSTKQEHFPDN

SEQ ID NO: 517 - protein, 208 aa, Artificial Sequence
  CD80 v64 ECD
VIHVTKEVKEVATLSCGHNVSVEELAQTRIYWQKEKKMVLTMMSGDMNIWPEYKNRTIFDITNNLSIVIQALRPSDEGTYACVVLKYEKDGFKREHLAEVTLSVKADFPTPSISDFEVPSSNIRRITCSASGGFPEPHLSWLENGEELNAINTTVSQDPETELYAVSSKLDFNMTTNHSFMCLIKYGHLRVNQTFNWNTTKQEHFPDN

SEQ ID NO: 518 - protein, 208 aa, Artificial Sequence
  CD80 v65 ECD
VIHVTKEVKEVATLSCGHNVSVEELAQSRIYWQKEKKMVLTMMSGDMNIWPEYKNRTIFDITNNLSIVIQALRPSDEGTYECVVLKYEKDGFKRKHLAEVTLSVKADFPTPSISDFEVPSSNIRRVICSASGGFPEPHLSWLENGEELNAINTTVSQDPETELYAVSNKLDFNMTTNHSFMCLIKYGHLRVNQTFNWNTTKQEHFPDN

SEQ ID NO: 519 - protein, 208 aa, Artificial Sequence
  CD80 v66 ECD
VIHVTKEVKEVATLSCGHNVSVEELAQTRIYWQKEKKMVLTMMSGDMNIWPEYKNRTIFDITSNLSIVIQALRPSDEGTYECVVLKYEKDGFKREHLAEVTLSVKADFPTPSITDFEVPSSNIRRIICSASGGFPEPHLSWLENGEELNAINTTVSQDPETELYAVSSKLDFNMTTNHSFMCLIKYGDLRVNQTFNWNTTKQEHFPDN

SEQ ID NO: 520 - protein, 208 aa, Artificial Sequence
  CD80 v67 ECD
VIHVTKEVKEVATLSCGHNVSVEELAQTRIYWQKEEKMVLTMMSGDMNIWPEYKNRTIFDITNNLSTVIQALRPSDEGTYECVVLKYEKDGFKREHLAEVTLSVKADFPTPSISDFEVPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 521 - protein, 208 aa, Artificial Sequence
  CD80 v68 ECD
VIHVTKEVKEVATLSCGHNVSVEELAQTRIYWQKEKKMVLTMMSGDMNIWPGYKNRTIFDITNNLSIVIQALRPSDEGTYECVVLKYEKDGFKREHLAEVTLSVKANFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 522 - protein, 208 aa, Artificial Sequence
  CD80 v69 ECD
VIHVTKEVKEVATLSCGHNVSVEELAQTRIYWQKEKEMVLTMMSGDMNIWPEYKNRTISDITNNLSIVIQALRPSDEGTYECVVLKYEKDGFKREHLAEVTLSVKADFPTPSISDFEVPSSNIRRIICSASGGFPEPHLSWLENGEELNAINTTVSQDPETELYAVSSKLDFNMTTNHSFMCLIEYGHLRVNQTFNWNTTKQEHFPDN

SEQ ID NO: 523 - protein, 208 aa, Artificial Sequence
  CD80 v70 ECD
VIHVTKEVKEVATLSCGHNVSVEELAQTRIYWQKEKKMVLTMMSGDMNIWPEYKNRTIFVITNNLSIVILALRPSDEGTYECVVLKYEKDGFKREHLAEVTLSVKADFPTPSISDFEVPSSNIRRIICSASGGFPEPHLSWLENGEELNAINTTVSQDPETELYAVSSELDFNMTTNHSFMCLIKYGHLRVNQTFNWNTTKQEHFPDN

SEQ ID NO: 524 - protein, 208 aa, Artificial Sequence
  CD80 v71 ECD
VIHVTKEVKEVATLSCGHNVSVEELAQTRIYWQKEKKMVLTMMSGDMNIWPEYMNRTIFDITNNLSIVIQALRPSDEGTYECVVLKYEKDGFKREHLAEVTLSVKADFPTPSISDFEIPTSNIRRIICSTSGGFPEPHLSWLENGEELNAINTTVSQDPETELHAVSSKLDFNMTTNHSFMCLIKYGDLRVNQTFNWNTTKQEHFPDN

SEQ ID NO: 525 - protein, 208 aa, Artificial Sequence
  CD80 v72 ECD
VIHVTKEVKEVATLSCGHNVSVEELAQTRIYWQKEKKTVLTMMSGDMNIWPEYKNRTIFDITNNLSIVIQALRPSDGGTYECVVLKYEKDGFKREHLAEVTLSVKADFPTPSISDFEVPSSNIRRIICSASGGFPEPHLSWLENGEELNAITTTVSQDPETELYAVSSKLDFNMTTNHSFMCLIKYGHLRVNQTFNWNTTKQEHFPDN

SEQ ID NO: 526 - protein, 208 aa, Artificial Sequence
  CD80 v73 ECD
VIHVTKEVKEVATLSCGHNVSVEELAQTRIHWQKEKKMVLGMLSGDMNIWPEYKNRTIFDITNNLSIVIQALRPSDEGTYECVVLKYEKDGFKREHLAEVTLSVKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 527 - protein, 208 aa, Artificial Sequence
  CD80 v74 ECD
VIHVTKEVKEVATLSCGHNVSVEELAQTRIYWQKEKKMVLTMMSGDMNIWPEYKNRTIFDITNNHSIVILALRPSDEGTYECVVLKYEKGAFKREHLAEVTLSVKADFPAPSISDLEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 528 - protein, 208 aa, Artificial Sequence
  CD80 v75 ECD
VIHVTKEVKEVATLSCGHNVSVEELAQTHIYWQKEKKMVLTMMSGDMNIWPGYKNRTIFDITNNLSIVILALRPSDEGTYECVVLKYEKNAFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 529 - protein, 208 aa, Artificial Sequence; identical to SEQ ID NO: 528
  CD80 v76 ECD

SEQ ID NO: 530 - protein, 208 aa, Artificial Sequence
  CD80 v77 ECD
VIHVTKEVKEVATLSCGHNVSVEELAQTRIYWQKEKKMVLTMMSGDMNIWPEYKNRTIFDITNNLSTVIQALRPSDEGTYECVVLKYEKDGFKREHLAEVTLSVKADFPTPSISDFEVPSSNIRRIICSTSGGFPEPHLSWLENGEELNAINTTVSQDPETELYAVSSKLDFNMTTNHSFMCLIKYGHLRVNQTFHWNTTKQEHFPDN

SEQ ID NO: 531 - protein, 208 aa, Artificial Sequence
  CD80 v78 ECD
VIHVTKEVKEVATLSCGHNVSVEELAQTRIYWQKEKKMVLTMMSGDMNIWPEYKNRTIFDITNNLSIVIQALRPSDEGTYECVVLKYEKDGFKREHLAEVTLSVKADFPAPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 532 - protein, 208 aa, Artificial Sequence
  CD80 v79 ECD
VIHVTKEVKEVATLSCGHNVSVEELAQTRIYWQKEKKVVLDMISGDMNIGPEYKNRTIFDITNNLSIVILALRPSGEGTYECAVLKYEEDAFKREHLAEVTLSVKADFPTPSISDFEVPSSNIRRVICSASGGFPEPHLSWLENGEELNAINTTVSQDPETELYAVSSKLDFNMTTNHSFMCLIKYGHLRVNQTFNWNTTKQEHFPDN

SEQ ID NO: 533 - protein, 208 aa, Artificial Sequence
  CD80 v80 ECD
VIHVTKEVKEVVTLFCGHNVSVEELAQTRIHWQKEKKLVLGMLSGDMNIWPEYKNRTIFDITNNLSIVILALRPSDEGTYECVVLKYEKNAFKREHLAEVTLSVKADFPTPSISDFEIPTSNIRRIICSASGGFPELHLSWLENGEELDAITTTVSQDPETELYAVSSKLDFNMTTNHSFMCLIKYGHLRVNQTFNWNTTKQEHFPDN

SEQ ID NO: 534 - protein, 208 aa, Artificial Sequence
  CD80 v81 ECD
VIHVTKEVKEVATLSCGHNVSVEELAQTRIYWQKEKKMVLTMMSGDMNIWPEYKNRTIFDITNNLSFVIRALRPSDEGTYECVVLKYGKDGFKREHLAEVTLSVKADFPTPSISDFEVPSSNIRRIICSASGGFPEPHLSWLENGEELNAINTTVSQDPETELYAVSSKLDFNMTTNHSFMCLIKYGHLRVNQTFNWNTTKQEHFPDN

SEQ ID NO: 535 - protein, 208 aa, Artificial Sequence
  CD80 v82 ECD
VIHVTKEVKEVATLSCGHNVSVEGPAQTRIYWQKEKKMVLTMMSGDMNIWPEYKNRTIFDITNNLSIVIQALRPSDEGTYECVVLKYEKDGFKREHLAEVTLSVKADFPTPSISDFEVPSSNIRRIICSTSGGFPEPHLSWLENGEELNAITTTVSQDPETELYAVSSKLDFNMTTNHSFMCLIKYGHLRVNQTFNWNTTKQEHFPDN

SEQ ID NO: 536 - protein, 208 aa, Artificial Sequence
  CD80 v83 ECD
VIHVTKEVKEVATLSCGHNVSVEELAQTRIYWQKEKKMVLTMMSGDMNIWPEYKNRTIFDITNNLSIVILALRPSDEGTYECVVLKYEKDGLKREHLAEVTLSVKADLPTPSISDFEVPSSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 537 - protein, 208 aa, Artificial Sequence
  CD80 v84 ECD
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKADFPTPSISDFEIPTSSIRRIICSTSGGFPEPHLSWLENGEELNAINTTVSQDPETELYAVSSKLDFNMTTSHSFMCLIKYGHLRVNQTFNWNTTKQEHFPDN

SEQ ID NO: 538 - protein, 208 aa, Artificial Sequence; identical to SEQ ID NO: 102
  CD80 v85 ECD

SEQ ID NO: 539 - protein, 208 aa, Artificial Sequence
  CD80 v86 ECD
VIHVTKEVKEVATLSCGHNVSVEELAQTRIYWQKEGQIVMTMMSGDMNIWPEYKNRTILDITNNLSIVILALRPSDEGTYVCVVRKYENDTPVLEHLAGVTLSVKADFPTPSISDFEIPTSNIRRIICSASGGFPEPHLSWLENGEELSAINTTVSQDPETELYAVSSKLDFNMTTNHSFMCLIKYGHLRVNQTFNWNTTKQEHFPDN

SEQ ID NO: 540 - protein, 208 aa, Artificial Sequence
  CD80 v87 ECD
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDN

SEQ ID NO: 541 - protein, 101 aa, Artificial Sequence; identical to SEQ ID NO: 189
  CD80 v85 IgV

SEQ ID NO: 542 - protein, 101 aa, Artificial Sequence
  CD80 v87 IgV
  VARIANT (94)..(94): X is R or Q
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVT

SEQ ID NO: 543 - protein, 107 aa, Artificial Sequence
  CD80 v85 IgV
VIHVTKEVKEVATLSCGHNVSVEELAQTRIYWQKEKKMVLTMMSGDMNIWPEYKNRTIFDITNNLSIVILALRPSDEGTYECVVLKYDRKGYRREHLAEVTLSVKAD

SEQ ID NO: 544 - protein, 107 aa, Artificial Sequence
  CD80 v87 IgV
VIHVTKEVKEVATLSCGHNVSVEELAQTRIYWQKEGKMVMTMMSGDMNIWPEYKNRTIFDITNNLSIVILALRPSDEGTYECVVLKYEKDAFKREHLAEVTLSVKAD

SEQ ID NO: 545 - protein, 122 aa, Homo sapiens
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 546 - protein, 122 aa, Artificial Sequence
  ICOSL v1 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANFSV

SEQ ID NO: 547 - protein, 122 aa, Artificial Sequence
  ICOSL v2 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSV

SEQ ID NO: 548 - protein, 122 aa, Artificial Sequence
  ICOSL v3 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSV

SEQ ID NO: 549 - protein, 122 aa, Artificial Sequence
  ICOSL v5 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSV

SEQ ID NO: 550 - protein, 122 aa, Artificial Sequence
  ICOSL v10 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQRFHCLVLSQSLGFQEVLSVEVTLHVAANFSV

SEQ ID NO: 551 - protein, 122 aa, Artificial Sequence
  ICOSL v11 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLGQSLGFQEVLSVEVTLHVAANFSV

SEQ ID NO: 552 - protein, 122 aa, Artificial Sequence
  ICOSL v12 IgV
DTQEKEVRAMVGSDVELSCACPEGSRFDLNDVYVYWQTSESKTVVTYHIPQYSSLENVDSRYRNRALMSPAGMLRGDFSLRLFNVTPQDEQKFHCLVLSQSLGFQEVLSVEVTLHVAANFSV

SEQ ID NO: 553 - protein, 122 aa, Artificial Sequence
  ICOSL v13 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSQSLGFQEVLSVEVTLHVAANFSV

SEQ ID NO: 554 - protein, 122 aa, Artificial Sequence
  ICOSL v14 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSPSLGFQEVLSVEVTLHVAANFSV

SEQ ID NO: 555 - protein, 122 aa, Artificial Sequence
  ICOSL v21 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVELHVAANFSV

SEQ ID NO: 556 - protein, 122 aa, Artificial Sequence
  ICOSL v22 IgV
DTQEKEVRAMVGSDVELSCACPEGSRFDLNDVYVYWQTSESKTVVTYHIPQNSALENVDSRYRNRALMSPAGMLRGDFSLRLFNVTPQDEQKFHCLVLSQSLGFQEVLSVEVTLHVAANFSV

SEQ ID NO: 557 - protein, 122 aa, Artificial Sequence
  ICOSL v23 IgV
DTQEKEVRAMVGSDVELSCACPEGSRFDLNDVYVYWQTSESKTVVTYHIPQDSPLENVDSRYRNRALMSPAGMLRGDFSLRLFNVTPQDEQKFHCLVLSQSLGFQEVLSVEVTLHVAANFSV

SEQ ID NO: 558 - protein, 122 aa, Artificial Sequence
  ICOSL v28 IgV
DTQEKEVRAMVGSDVELSCACPEGSRFDLNDVYVYWQTSESKTVVTYHIPQSSSLENVDSRYRNRALMSPAGMLRGDFSPRLFNVTPQDEQKFHCLVLSQSLGFQEVLSVEVTLHVAANFSV

SEQ ID NO: 559 - protein, 122 aa, Artificial Sequence
  ICOSL v33 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLGFQEVLSVEVTLHVAANFSV

SEQ ID NO: 560 - protein, 122 aa, Artificial Sequence
  ICOSL v34 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFDCFVFSRSLEFQEVLSVEVTLHVAANSSV

SEQ ID NO: 561 - protein, 122 aa, Artificial Sequence
  ICOSL v35 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLEFQEVLSVEVTLHVAANFSV

SEQ ID NO: 562 - protein, 122 aa, Artificial Sequence
  ICOSL v36 IgV
DTQEKEVRAMVGSDVELSCACPEGSRFDLNDVYVYWQTSESKTVVTYHIPQHSSLENVDSRYRNRALMSPAGMLRGDLSLRLFNVTPQDEQKFHCLVLSRSLGFQEVLSVEVTLHVAANFSV

SEQ ID NO: 563 - protein, 122 aa, Artificial Sequence
  ICOSL v37 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSV

SEQ ID NO: 564 - protein, 122 aa, Artificial Sequence
  ICOSL v38 IgV
DTQEKEVRAMVGSDVELSCACPEGSRFDLNDVYVYWQTSESKTVVTYHIPQHSSLEYVDSRYRNRALMSPAGMLQGDFSLRLFNVTPQDEQKFHCLVLSRSLGFQEVLSDEVTLHVAANFSV

SEQ ID NO: 565 - protein, 122 aa, Artificial Sequence
  ICOSL v39 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSV

SEQ ID NO: 566 - protein, 122 aa, Artificial Sequence
  ICOSL v40 IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSRSLGFQEVLSDEVTLHVAANFSV

SEQ ID NO: 567 - protein, 122 aa, Artificial Sequence
  ICOSL v41 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSV

SEQ ID NO: 568 - protein, 122 aa, Artificial Sequence
  ICOSL v42 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFGV

SEQ ID NO: 569 - protein, 122 aa, Artificial Sequence
  ICOSL v43 IgV
DTQEKEVRAMVGSDVELSCVCPEGSRFDLNDVYVYWQTSESKTVVTYHIPQHSSLEYVDSRYRNRALMSPAGMLRGDFSLRLFNVTPQDEQKFHCLVLSRSLGFQEVLGVEVTLHVAANFSV

SEQ ID NO: 570 - protein, 122 aa, Artificial Sequence; identical to SEQ ID NO: 549
  ICOSL v44 IgV

SEQ ID NO: 571 - protein, 122 aa, Artificial Sequence
  ICOSL v46 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSA

SEQ ID NO: 572 - protein, 122 aa, Artificial Sequence
  ICOSL v48 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLHVAANFSV

SEQ ID NO: 573 - protein, 122 aa, Artificial Sequence
  ICOSL v49 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLHVAANSSV

SEQ ID NO: 574 - protein, 122 aa, Artificial Sequence
  ICOSL v50 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLALSQSLGFQEVLSVEVTLHVAANFSV

SEQ ID NO: 575 - protein, 122 aa, Artificial Sequence
  ICOSL v51 IgV
DTQEKEVRAMVGSDVELSCACPEGSRFDLNDVYVYWQTSESKTVVTYHIPQSSSLENVDSRYRNRALMSPARMLRGDFSLRLFNVTPQDEQKFHCLVLSQSLGFQEVLSVEVTLHVAANFSV

SEQ ID NO: 576 - protein, 122 aa, Artificial Sequence
  ICOSL v52 IgV
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVEVTLHVTANFSV

SEQ ID NO: 577 - protein, 122 aa, Artificial Sequence
  ICOSL v54 IgV
DTQEKEVRAMVGSDVELSCACPEGSRFDLNDVYVYWQTSESKTVVTHHIPQSSSLENVDSRYRNRALMSPAGMLRGDFSLRLFNVTPQDEQKFHCLVLSQSLGFQEALSVEVTLHVAANSSV

SEQ ID NO: 578 - protein, 122 aa, Artificial Sequence
  ICOSL v60 IgV
DTQEKEVRAMVGSDVELSCACPEGSRSDLNDVYVYWQTSESKTVVTYHIPQHSSLEYVDSRYRNRALMSPAGMLRGDFSLRLFNVTPQDEQKFHCLVLSQSLGFQEVLSNEVTLHVAANFSV

SEQ ID NO: 579 - protein, 122 aa, Artificial Sequence
  ICOSL v65 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLSVEVTLHVAANFSM

SEQ ID NO: 580 - protein, 122 aa, Artificial Sequence
  ICOSL v78 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECLVFSRSLGFQEVLSVEVTLHVAANFSV

SEQ ID NO: 581 - protein, 122 aa, Artificial Sequence
  ICOSL v79 IgV
DTQEKEVRAMVGSDVELSCACPEGSRFDLNDVYVYWQTSESKTVVTYHIPQSSSLENVDSRYRNRALMSPAGMLRGDFSLRLFNVTPQDAQKFHCLVLSQSLGFQEVLSVEVTLHVAANFSV

SEQ ID NO: 582 - protein, 122 aa, Artificial Sequence
  ICOSL v80 IgV
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLHVAANFSV

SEQ ID NO: 583 - protein, 122 aa, Artificial Sequence
  ICOSL v85 IgV
DTQEKEVRAMVGSDVELSCACPEGSRFDLNDVYVYWQTSESKTVVTYHIPQSSPLENVDSRYRNRALMSPAGMLRGDFSLRLFNVTPQDEQKFHCLVLSQSLGFQEVLSVEVTLHVAANFSV

SEQ ID NO: 584 - protein, 122 aa, Artificial Sequence
  ICOSL v86 IgV
DTQEKEVRAMVGSDVELSCACPEGSRFDLNDVYVYWQPSESKTVVTYHIPQSSSLEDVDSRYRNRALMSPAGMLRGDFSLRLFNVTPQDEQKFHCLVLSQSLGFQEVLSVEVTLHVAANFSV

SEQ ID NO: 585 - protein, 121 aa, Artificial Sequence
  ICOSL v87 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVVTLHVAANFSV

SEQ ID NO: 586 - protein, 121 aa, Artificial Sequence
  ICOSL v88 IgV
DTQEKEVRAMVGSDVELSCACPEGSRFDLNDVVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 587 - protein, 122 aa, Artificial Sequence
  ICOSL v91  IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSQSLGFQEVLSDEVTLHVAANFSV

SEQ ID NO: 588 - protein, 122 aa, Artificial Sequence
  ICOSL v99 IgV
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAANFSV

SEQ ID NO: 589 - protein, 122 aa, Artificial Sequence
  ICOSL v100 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAAQFSV

SEQ ID NO: 590 - protein, 122 aa, Artificial Sequence
  ICOSL v111 IgV
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAANFSV

SEQ ID NO: 591 - protein, 122 aa, Artificial Sequence
  ICOSL v112 IgV
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAAQFSV

SEQ ID NO: 592 - protein, 122 aa, Artificial Sequence
  ICOSL v113 IgV
DTQEKEVRAMVGSDVELSCACPEGSRFDLNDVYVYWQTSESKTVVTYHIPQNSSLENVDSRYRNRALMSPAGMLRGDFSLRLFQVTPQDEQKFHCLVLSQSLGFQEVLSVEVTLHVAAQFSV

SEQ ID NO: 593 - protein, 122 aa, Artificial Sequence
  ICOSL v126 IgV
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAAQFSV

SEQ ID NO: 594 - protein, 122 aa, Artificial Sequence
  ICOSL v137 IgV
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSRSLGFQEVLSVEVTLHVAANFSV

SEQ ID NO: 595 - protein, 122 aa, Artificial Sequence
  ICOSL v153 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSQSLGFQEVLSVEVTLRVAANFSV

SEQ ID NO: 596 - protein, 122 aa, Artificial Sequence
  ICOSL v154 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLRVAANFSV

SEQ ID NO: 597 - protein, 122 aa, Artificial Sequence
  ICOSL v163 IgV
DTQEKEVRAMVGSDVELSCACPEGSRFDLDDVYVYWQTSESETVVTYHIPQSSSLENVDSRYRNRALMSPAGMLRGDFSLRLFNVTPQDEQKFHCLVLSQSLGFQEVLSVEVTLRVAANFSV

SEQ ID NO: 598 - protein, 122 aa, Artificial Sequence; identical to SEQ ID NO: 597
  ICOSL v164 IgV

SEQ ID NO: 599 - protein, 122 aa, Artificial Sequence
  ICOSL v173 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLRVAANFSV

SEQ ID NO: 600 - protein, 208 aa, Artificial Sequence
  ICOSL WT ECD Truncation 2
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNL

SEQ ID NO: 601 - protein, 213 aa, Artificial Sequence
  ICOSL WT ECD Truncation 3
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQ

SEQ ID NO: 602 - protein, 207 aa, Artificial Sequence
  ICOSL WT ECD Truncation 4
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQN

SEQ ID NO: 603 - protein, 206 aa, Artificial Sequence
  ICOSL WT ECD Truncation 5
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQ

SEQ ID NO: 604 - protein, 204 aa, Artificial Sequence
  ICOSL WT ECD Truncation 6
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLL

SEQ ID NO: 605 - protein, 201 aa, Artificial Sequence
  ICOSL WT ECD Truncation 7
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIEN

SEQ ID NO: 606 - protein, 209 aa, Artificial Sequence
  ICOSL WT ECD Truncation 8
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLT

SEQ ID NO: 607 - protein, 208 aa, Artificial Sequence
  ICOSL N207A ECD Truncation 2
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQAL

SEQ ID NO: 608 - protein, 208 aa, Artificial Sequence
  ICOSL N207G ECD Truncation 2
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGL

SEQ ID NO: 609 - protein, 208 aa, Artificial Sequence
  ICOSL L208G ECD Truncation 2
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNG

SEQ ID NO: 610 - protein, 213 aa, Artificial Sequence
  ICOSL N207A ECD Truncation 3
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQALTVGSQ

SEQ ID NO: 611 - protein, 213 aa, Artificial Sequence
  ICOSL N207G ECD Truncation 3
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGLTVGSQ

SEQ ID NO: 612 - protein, 213 aa, Artificial Sequence
  ICOSL L208G ECD Truncation 3
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNGTVGSQ

SEQ ID NO: 613 - protein, 207 aa, Artificial Sequence
  ICOSL N207A ECD Truncation 4
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQA

SEQ ID NO: 614 - protein, 207 aa, Artificial Sequence
  ICOSL N207G ECD Truncation 4
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQG

SEQ ID NO: 615 - protein, 209 aa, Artificial Sequence
  ICOSL N207A ECD Truncation 8
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQALT

SEQ ID NO: 616 - protein, 209 aa, Artificial Sequence
  ICOSL N207G ECD Truncation 8
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGLT

SEQ ID NO: 617 - protein, 209 aa, Artificial Sequence
  ICOSL L208G ECD Truncation 8
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNGT

SEQ ID NO: 618 - protein, 208 aa, Artificial Sequence
  ICOSL N207A/L208G ECD Truncation 2
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQAG

SEQ ID NO: 619 - protein, 208 aa, Artificial Sequence
  ICOSL N207G/L208G ECD Truncation 2
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGG

SEQ ID NO: 620 - protein, 213 aa, Artificial Sequence
  ICOSL N207A/L208G ECD Truncation 3
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQAGTVGSQ

SEQ ID NO: 621 - protein, 213 aa, Artificial Sequence
  ICOSL N207G/L208G ECD Truncation 3
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGGTVGSQ

SEQ ID NO: 622 - protein, 209 aa, Artificial Sequence
  ICOSL N207A/L208G ECD Truncation 8
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQAGT

SEQ ID NO: 623 - protein, 209 aa, Artificial Sequence
  ICOSL N207G/L208G ECD Truncation 8
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGGT

SEQ ID NO: 624 - protein, 238 aa, Artificial Sequence
  ICOSL N207A Full ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQALTVGSQTGNDIGERDKITENPVSTGEKNAAT

SEQ ID NO: 625 - protein, 238 aa, Artificial Sequence
  ICOSL N207G Full ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGLTVGSQTGNDIGERDKITENPVSTGEKNAAT

SEQ ID NO: 626 - protein, 238 aa, Artificial Sequence
  ICOSL L208G Full ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNGTVGSQTGNDIGERDKITENPVSTGEKNAAT

SEQ ID NO: 627 - protein, 238 aa, Artificial Sequence
  ICOSL N207A/L208G Full ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQAGTVGSQTGNDIGERDKITENPVSTGEKNAAT

SEQ ID NO: 628 - protein, 238 aa, Artificial Sequence
  ICOSL N207G/L208G Full ECD
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQGGTVGSQTGNDIGERDKITENPVSTGEKNAAT

SEQ ID NO: 629 - protein, 5 aa, Artificial Sequence
  EAAAK Linker
EAAAK

SEQ ID NO: 630 - protein, 15 aa, Artificial Sequence
  3x EAAAK Linker
EAAAKEAAAKEAAAK

SEQ ID NO: 631 - protein, 25 aa, Artificial Sequence
  5x EAAAK Linker
EAAAKEAAAKEAAAKEAAAKEAAAK

SEQ ID NO: 632 - protein, 231 aa, Artificial Sequence
  Fc (C5S (C220S), R77C, (R292C),  N82G (N297G), V87C (V302C), L232del (K447del))
EPKSSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 633 - protein, 231 aa, Artificial Sequence
  Fc with C220S/L234A/L235E/G237A/K447del
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 634 - protein, 230 aa, Artificial Sequence
  Fc with C220S/E233P/L234V/L235A/G236del/S267K/K447del
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 635 - protein, 7 aa, Artificial Sequence
  Linker
GSGGGGS

SEQ ID NO: 636 - protein, 5 aa, Artificial Sequence
  4GS Linker
GGGGS

SEQ ID NO: 637 - protein, 231 aa, Artificial Sequence
  Fc region
EPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 638 - protein, 238 aa, Artificial Sequence
  ICOSL v180 ECD
DTQEKEVRAMVGSDVELSCACPEGSRFDLNDVYVYWQTSESKTVVTYHIPQASSLEFVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 639 - protein, 238 aa, Artificial Sequence
  ICOSL v181 ECD
DTQEKEVRAMVGSDVELSCACPEGSRFDLNDVYVYWQTSESKTVVTYHIPQASSLEHVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 640 - protein, 238 aa, Artificial Sequence
  ICOSL v182 ECD
DTQEKEVRAMVGSDVELSCACPEGSRFDLNDVYVYWQTSESKTVVTYHIPQASSLEYVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 641 - protein, 238 aa, Artificial Sequence
  ICOSL v183 ECD
DTQEKEVRAMVGSDVELSCACPEGSRFDLNDVYVYWQTSESKTVVTYHIPQDSSLEAVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 642 - protein, 238 aa, Artificial Sequence
  ICOSL v184 ECD
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 643 - protein, 238 aa, Artificial Sequence
  ICOSL v185 ECD
DTQEKEVRAMVGSDVELSCACPEGSRFDLNDVYVYWQTSESKTVVTYHIPQGSSLENVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 644 - protein, 238 aa, Artificial Sequence
  ICOSL v186 ECD
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 645 - protein, 238 aa, Artificial Sequence
  ICOSL v187 ECD
DTQEKEVRAMVGSDVELSCACPEGSRFDLNDVYVYWQTSESKTVVTYHIPQMSSLEHVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 646 - protein, 238 aa, Artificial Sequence
  ICOSL v188 ECD
DTQEKEVRAMVGSDVELSCACPEGSRFDLNDVYVYWQTSESKTVVTYHIPQMSSLEWVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 647 - protein, 238 aa, Artificial Sequence
  ICOSL v189 ECD
DTQEKEVRAMVGSDVELSCACPEGSRFDLNDVYVYWQTSESKTVVTYHIPQQSSLEFVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 648 - protein, 238 aa, Artificial Sequence
  ICOSL v190 ECD
DTQEKEVRAMVGSDVELSCACPEGSRFDLNDVYVYWQTSESKTVVTYHIPQQSSLESVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 649 - protein, 238 aa, Artificial Sequence
  ICOSL v191 ECD
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 650 - protein, 238 aa, Artificial Sequence
  ICOSL v192 ECD
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 651 - protein, 238 aa, Artificial Sequence
  ICOSL v193 ECD
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 652 - protein, 238 aa, Artificial Sequence
  ICOSL v194 ECD
DTQEKEVRAMVGSDVELSCACPEGSRFDLNDVYVYWQTSESKTVVTYHIPQSSSLEAVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 653 - protein, 238 aa, Artificial Sequence
  ICOSL v195 ECD
DTQEKEVRAMVGSDVELSCACPEGSRFDLNDVYVYWQTSESKTVVTYHIPQSSSLEHVDSRYRNRALMSPAGMLRGDFSLRLFNVTPQDEQKFHCLVLSESLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 654 - protein, 238 aa, Artificial Sequence
  ICOSL v196 ECD
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 655 - protein, 238 aa, Artificial Sequence
  ICOSL v197 ECD
DTQEKEVRAMVGSDVELSCACPEGSRFDLNDVYVYWQTSESKTVVTYHIPQSSSLEMVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 656 - protein, 238 aa, Artificial Sequence
  ICOSL v198 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 657 - protein, 238 aa, Artificial Sequence
  ICOSL v199 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSMSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 658 - protein, 238 aa, Artificial Sequence
  ICOSL v200 ECD
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSVSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 659 - protein, 238 aa, Artificial Sequence
  ICOSL v201 ECD
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 660 - protein, 238 aa, Artificial Sequence
  ICOSL v202 ECD
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 661 - protein, 238 aa, Artificial Sequence
  ICOSL v203 ECD
DTQEKEVRAMVGSDVELSCACPEGSRFDLNDVYVYWQTSESKTVVTYHIPQTSSLEYVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 662 - protein, 238 aa, Artificial Sequence
  ICOSL v204 ECD
DTQEKEVRAMVGSDVELSCACPEGSRFDLNDVYVYWQTSESKTVVTYHIPQVSSLELVDSRYRNRALMSPAGMLRGDFSLRLFNVTPQDEQKFHCLVLSASLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 663 - protein, 238 aa, Artificial Sequence
  ICOSL v205 ECD
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 664 - protein, 238 aa, Artificial Sequence
  ICOSL v206 ECD
DTQEKEVRAMVGSDVELSCACPEGSRFDLNDVYVYWQTSESKTVVTYHIPQKSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 665 - protein, 238 aa, Artificial Sequence
  ICOSL v207 ECD
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 666 - protein, 238 aa, Artificial Sequence
  ICOSL v208 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSNSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 667 - protein, 238 aa, Artificial Sequence
  ICOSL v209 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 668 - protein, 238 aa, Artificial Sequence
  N52R, N57F, Q100R
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 669 - protein, 238 aa, Artificial Sequence
  ICOSL v211 ECD
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSTSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 670 - protein, 238 aa, Artificial Sequence
  ICOSL v212 ECD
DTQEKEVRAMVGSDVELSCACPEGSRFDLNDVYVYWQTSESKTVVTYHIPQRSSLEHVDSRYRNRALMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 671 - protein, 238 aa, Artificial Sequence
  ICOSL v213 ECD
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 672 - protein, 238 aa, Artificial Sequence
  ICOSL v214 ECD
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSKSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 673 - protein, 238 aa, Artificial Sequence
  ICOSL v215 ECD
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 674 - protein, 238 aa, Artificial Sequence
  ICOSL v216 ECD
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 675 - protein, 238 aa, Artificial Sequence
  ICOSL v217 ECD
DTQEKEVRAMVGSDVELSCACPEGSRFDLNDVYVYWQTSESKTVVTYHIPQCSSLEEVDSRYRNRALMSPAGMLRGDFSLRLFNVTPQDEQKFHCLVLSSSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 676 - protein, 238 aa, Artificial Sequence
  ICOSL v218 ECD
DTQEKEVRAMVGSDVELSCACPEGSRFDLNDVYVYWQTSESKTVVTYHIPQGSSLEPVDSRYRNRALMSPAGMLRGDFSLRLFNVTPQDEQKFHCLVLSDSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 677 - protein, 238 aa, Artificial Sequence
  ICOSL v219 ECD
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSGSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 678 - protein, 238 aa, Artificial Sequence
  ICOSL v220 ECD
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 679 - protein, 238 aa, Artificial Sequence
  ICOSL v221 ECD
DTQEKEVRAMVGSDVELSCACPEGSRFDLNDVYVYWQTSESKTVVTYHIPQLSSLEVVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 680 - protein, 238 aa, Artificial Sequence
  ICOSL v222 ECD
DTQEKEVRAMVGSDVELSCACPEGSRFDLNDVYVYWQTSESKTVVTYHIPQPSSLEPVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 681 - protein, 238 aa, Artificial Sequence
  ICOSL v223 ECD
DTQEKEVRAMVGSDVELSCACPEGSRFDLNDVYVYWQTSESKTVVTYHIPQPSSLESVDSRYRNRALMSPAGMLRGDFSLRLFNVTPQDEQKFHCLVLSGSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 682 - protein, 238 aa, Artificial Sequence
  ICOSL v224 ECD
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSGSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 683 - protein, 238 aa, Artificial Sequence
  ICOSL v225 ECD
DTQEKEVRAMVGSDVELSCACPEGSRFDLNDVYVYWQTSESKTVVTYHIPQTSSLEKVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 684 - protein, 238 aa, Artificial Sequence
  ICOSL v226 ECD
DTQEKEVRAMVGSDVELSCACPEGSRFDLNDVYVYWQTSESKTVVTYHIPQVSSLETVDSRYRNRALMSPAGMLRGDFSLRLFNVTPQDEQKFHCLVLSLSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 685 - protein, 238 aa, Artificial Sequence
  ICOSL v227 ECD
DTQEKEVRAMVGSDVELSCACPEGSRFDLNDVYVYWQTSESKTVVTYHIPQNSSLEQVDSRYRNRALMSPAGMLRGDFSLRLFNVTPQDEQKFHCLVLSPSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 686 - protein, 111 aa, Artificial Sequence
  ICOSL v180 IgV
DTQEKEVRAMVGSDVELSCACPEGSRFDLNDVYVYWQTSESKTVVTYHIPQASSLEFVDSRYRNRALMSPAGMLRGDFSLRLFNVTPQDEQKFHCLVLSSSLGFQEVLSVE

SEQ ID NO: 687 - protein, 111 aa, Artificial Sequence
  ICOSL v181 IgV
DTQEKEVRAMVGSDVELSCACPEGSRFDLNDVYVYWQTSESKTVVTYHIPQASSLEHVDSRYRNRALMSPAGMLRGDFSLRLFNVTPQDEQKFHCLVLSSSLGFQEVLSVE

SEQ ID NO: 688 - protein, 111 aa, Artificial Sequence
  ICOSL v182 IgV
DTQEKEVRAMVGSDVELSCACPEGSRFDLNDVYVYWQTSESKTVVTYHIPQASSLEYVDSRYRNRALMSPAGMLRGDFSLRLFNVTPQDEQKFHCLVLSASLGFQEVLSVE

SEQ ID NO: 689 - protein, 111 aa, Artificial Sequence
  ICOSL v183 IgV
DTQEKEVRAMVGSDVELSCACPEGSRFDLNDVYVYWQTSESKTVVTYHIPQDSSLEAVDSRYRNRALMSPAGMLRGDFSLRLFNVTPQDEQKFHCLVLSASLGFQEVLSVE

SEQ ID NO: 690 - protein, 111 aa, Artificial Sequence
  ICOSL v184 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSSSLGFQEVLSVE

SEQ ID NO: 691 - protein, 111 aa, Artificial Sequence
  ICOSL v185 IgV
DTQEKEVRAMVGSDVELSCACPEGSRFDLNDVYVYWQTSESKTVVTYHIPQGSSLENVDSRYRNRALMSPAGMLRGDFSLRLFNVTPQDEQKFHCLVLSASLGFQEVLSVE

SEQ ID NO: 692 - protein, 111 aa, Artificial Sequence
  ICOSL v186 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSASLGFQEVLSVE

SEQ ID NO: 693 - protein, 111 aa, Artificial Sequence
  ICOSL v187 IgV
DTQEKEVRAMVGSDVELSCACPEGSRFDLNDVYVYWQTSESKTVVTYHIPQMSSLEHVDSRYRNRALMSPAGMLRGDFSLRLFNVTPQDEQKFHCLVLSSSLGFQEVLSVE

SEQ ID NO: 694 - protein, 111 aa, Artificial Sequence
  ICOSL v188 IgV
DTQEKEVRAMVGSDVELSCACPEGSRFDLNDVYVYWQTSESKTVVTYHIPQMSSLEWVDSRYRNRALMSPAGMLRGDFSLRLFNVTPQDEQKFHCLVLSPSLGFQEVLSVE

SEQ ID NO: 695 - protein, 111 aa, Artificial Sequence
  ICOSL v189 IgV
DTQEKEVRAMVGSDVELSCACPEGSRFDLNDVYVYWQTSESKTVVTYHIPQQSSLEFVDSRYRNRALMSPAGMLRGDFSLRLFNVTPQDEQKFHCLVLSQSLGFQEVLSVE

SEQ ID NO: 696 - protein, 111 aa, Artificial Sequence
  ICOSL v190 IgV
DTQEKEVRAMVGSDVELSCACPEGSRFDLNDVYVYWQTSESKTVVTYHIPQQSSLESVDSRYRNRALMSPAGMLRGDFSLRLFNVTPQDEQKFHCLVLSASLGFQEVLSVE

SEQ ID NO: 697 - protein, 111 aa, Artificial Sequence
  ICOSL v191 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSASLGFQEVLSVE

SEQ ID NO: 698 - protein, 111 aa, Artificial Sequence
  ICOSL v192 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSPSLGFQEVLSVE

SEQ ID NO: 699 - protein, 111 aa, Artificial Sequence
  ICOSL v193 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSSSLGFQEVLSVE

SEQ ID NO: 700 - protein, 111 aa, Artificial Sequence
  ICOSL v194 IgV
DTQEKEVRAMVGSDVELSCACPEGSRFDLNDVYVYWQTSESKTVVTYHIPQSSSLEAVDSRYRNRALMSPAGMLRGDFSLRLFNVTPQDEQKFHCLVLSASLGFQEVLSVE

SEQ ID NO: 701 - protein, 111 aa, Artificial Sequence
  ICOSL v195 IgV
DTQEKEVRAMVGSDVELSCACPEGSRFDLNDVYVYWQTSESKTVVTYHIPQSSSLEHVDSRYRNRALMSPAGMLRGDFSLRLFNVTPQDEQKFHCLVLSESLGFQEVLSVE

SEQ ID NO: 702 - protein, 111 aa, Artificial Sequence
  ICOSL v196 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSSSLGFQEVLSVE

SEQ ID NO: 703 - protein, 111 aa, Artificial Sequence
  ICOSL v197 IgV
DTQEKEVRAMVGSDVELSCACPEGSRFDLNDVYVYWQTSESKTVVTYHIPQSSSLEMVDSRYRNRALMSPAGMLRGDFSLRLFNVTPQDEQKFHCLVLSSSLGFQEVLSVE

SEQ ID NO: 704 - protein, 111 aa, Artificial Sequence
  ICOSL v198 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSSSLGFQEVLSVE

SEQ ID NO: 705 - protein, 111 aa, Artificial Sequence
  ICOSL v199 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSMSLGFQEVLSVE

SEQ ID NO: 706 - protein, 111 aa, Artificial Sequence
  ICOSL v200 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSVSLGFQEVLSVE

SEQ ID NO: 707 - protein, 111 aa, Artificial Sequence
  ICOSL v201 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSSSLGFQEVLSVE

SEQ ID NO: 708 - protein, 111 aa, Artificial Sequence
  ICOSL v202 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSASLGFQEVLSVE

SEQ ID NO: 709 - protein, 111 aa, Artificial Sequence
  ICOSL v203 IgV
DTQEKEVRAMVGSDVELSCACPEGSRFDLNDVYVYWQTSESKTVVTYHIPQTSSLEYVDSRYRNRALMSPAGMLRGDFSLRLFNVTPQDEQKFHCLVLSASLGFQEVLSVE

SEQ ID NO: 710 - protein, 111 aa, Artificial Sequence
  ICOSL v204 IgV
DTQEKEVRAMVGSDVELSCACPEGSRFDLNDVYVYWQTSESKTVVTYHIPQVSSLELVDSRYRNRALMSPAGMLRGDFSLRLFNVTPQDEQKFHCLVLSASLGFQEVLSVE

SEQ ID NO: 711 - protein, 111 aa, Artificial Sequence
  ICOSL v205 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSKSLGFQEVLSVE

SEQ ID NO: 712 - protein, 111 aa, Artificial Sequence
  ICOSL v206 IgV
DTQEKEVRAMVGSDVELSCACPEGSRFDLNDVYVYWQTSESKTVVTYHIPQKSSLEYVDSRYRNRALMSPAGMLRGDFSLRLFNVTPQDEQKFHCLVLSRSLGFQEVLSVE

SEQ ID NO: 713 - protein, 111 aa, Artificial Sequence
  ICOSL v207 IgV
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVE

SEQ ID NO: 714 - protein, 111 aa, Artificial Sequence
  ICOSL v208 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSNSLGFQEVLSVE

SEQ ID NO: 715 - protein, 111 aa, Artificial Sequence
  ICOSL v209 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSPSLGFQEVLSVE

SEQ ID NO: 716 - protein, 111 aa, Artificial Sequence
  ICOSL v210 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSRSLGFQEVLSVE

SEQ ID NO: 717 - protein, 111 aa, Artificial Sequence
  ICOSL v211 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSTSLGFQEVLSVE

SEQ ID NO: 718 - protein, 111 aa, Artificial Sequence
  ICOSL v212 IgV
DTQEKEVRAMVGSDVELSCACPEGSRFDLNDVYVYWQTSESKTVVTYHIPQRSSLEHVDSRYRNRALMSPAGMLRGDFSLRLFNVTPQDEQKFHCLVLSKSLGFQEVLSVE

SEQ ID NO: 719 - protein, 111 aa, Artificial Sequence
  ICOSL v213 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSSSLGFQEVLSVE

SEQ ID NO: 720 - protein, 111 aa, Artificial Sequence
  ICOSL v214 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSKSLGFQEVLSVE

SEQ ID NO: 721 - protein, 111 aa, Artificial Sequence
  ICOSL v215 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSQSLGFQEVLSVE

SEQ ID NO: 722 - protein, 111 aa, Artificial Sequence
  ICOSL v216 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSRSLGFQEVLSVE

SEQ ID NO: 723 - protein, 111 aa, Artificial Sequence
  ICOSL v217 IgV
DTQEKEVRAMVGSDVELSCACPEGSRFDLNDVYVYWQTSESKTVVTYHIPQCSSLEEVDSRYRNRALMSPAGMLRGDFSLRLFNVTPQDEQKFHCLVLSSSLGFQEVLSVE

SEQ ID NO: 724 - protein, 111 aa, Artificial Sequence
  ICOSL v218 IgV
DTQEKEVRAMVGSDVELSCACPEGSRFDLNDVYVYWQTSESKTVVTYHIPQGSSLEPVDSRYRNRALMSPAGMLRGDFSLRLFNVTPQDEQKFHCLVLSDSLGFQEVLSVE

SEQ ID NO: 725 - protein, 111 aa, Artificial Sequence
  ICOSL v219 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSGSLGFQEVLSVE

SEQ ID NO: 726 - protein, 111 aa, Artificial Sequence
  ICOSL v220 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSQSLGFQEVLSVE

SEQ ID NO: 727 - protein, 111 aa, Artificial Sequence
  ICOSL v221 IgV
DTQEKEVRAMVGSDVELSCACPEGSRFDLNDVYVYWQTSESKTVVTYHIPQLSSLEVVDSRYRNRALMSPAGMLRGDFSLRLFNVTPQDEQKFHCLVLSQSLGFQEVLSVE

SEQ ID NO: 728 - protein, 111 aa, Artificial Sequence
  ICOSL v222 IgV
DTQEKEVRAMVGSDVELSCACPEGSRFDLNDVYVYWQTSESKTVVTYHIPQPSSLEPVDSRYRNRALMSPAGMLRGDFSLRLFNVTPQDEQKFHCLVLSQSLGFQEVLSVE

SEQ ID NO: 729 - protein, 111 aa, Artificial Sequence
  ICOSL v223 IgV
DTQEKEVRAMVGSDVELSCACPEGSRFDLNDVYVYWQTSESKTVVTYHIPQPSSLESVDSRYRNRALMSPAGMLRGDFSLRLFNVTPQDEQKFHCLVLSGSLGFQEVLSVE

SEQ ID NO: 730 - protein, 111 aa, Artificial Sequence
  ICOSL v224 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSGSLGFQEVLSVE

SEQ ID NO: 731 - protein, 111 aa, Artificial Sequence
  ICOSL v225 IgV
DTQEKEVRAMVGSDVELSCACPEGSRFDLNDVYVYWQTSESKTVVTYHIPQTSSLEKVDSRYRNRALMSPAGMLRGDFSLRLFNVTPQDEQKFHCLVLSPSLGFQEVLSVE

SEQ ID NO: 732 - protein, 111 aa, Artificial Sequence
  ICOSL v226 IgV
DTQEKEVRAMVGSDVELSCACPEGSRFDLNDVYVYWQTSESKTVVTYHIPQVSSLETVDSRYRNRALMSPAGMLRGDFSLRLFNVTPQDEQKFHCLVLSLSLGFQEVLSVE

SEQ ID NO: 733 - protein, 111 aa, Artificial Sequence
  ICOSL v227 IgV
DTQEKEVRAMVGSDVELSCACPEGSRFDLNDVYVYWQTSESKTVVTYHIPQNSSLEQVDSRYRNRALMSPAGMLRGDFSLRLFNVTPQDEQKFHCLVLSPSLGFQEVLSVE

SEQ ID NO: 734 - protein, 122 aa, Artificial Sequence
  ICOSL v180 IgV
DTQEKEVRAMVGSDVELSCACPEGSRFDLNDVYVYWQTSESKTVVTYHIPQASSLEFVDSRYRNRALMSPAGMLRGDFSLRLFNVTPQDEQKFHCLVLSSSLGFQEVLSVEVTLHVAANFSV

SEQ ID NO: 735 - protein, 122 aa, Artificial Sequence
  ICOSL v181 IgV
DTQEKEVRAMVGSDVELSCACPEGSRFDLNDVYVYWQTSESKTVVTYHIPQASSLEHVDSRYRNRALMSPAGMLRGDFSLRLFNVTPQDEQKFHCLVLSSSLGFQEVLSVEVTLHVAANFSV

SEQ ID NO: 736 - protein, 122 aa, Artificial Sequence
  ICOSL v182 IgV
DTQEKEVRAMVGSDVELSCACPEGSRFDLNDVYVYWQTSESKTVVTYHIPQASSLEYVDSRYRNRALMSPAGMLRGDFSLRLFNVTPQDEQKFHCLVLSASLGFQEVLSVEVTLHVAANFSV

SEQ ID NO: 737 - protein, 122 aa, Artificial Sequence
  ICOSL v183 IgV
DTQEKEVRAMVGSDVELSCACPEGSRFDLNDVYVYWQTSESKTVVTYHIPQDSSLEAVDSRYRNRALMSPAGMLRGDFSLRLFNVTPQDEQKFHCLVLSASLGFQEVLSVEVTLHVAANFSV

SEQ ID NO: 738 - protein, 122 aa, Artificial Sequence
  ICOSL v184 IgV
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSSSLGFQEVLSVEVTLHVAANFSV

SEQ ID NO: 739 - protein, 122 aa, Artificial Sequence
  ICOSL v185 IgV
DTQEKEVRAMVGSDVELSCACPEGSRFDLNDVYVYWQTSESKTVVTYHIPQGSSLENVDSRYRNRALMSPAGMLRGDFSLRLFNVTPQDEQKFHCLVLSASLGFQEVLSVEVTLHVAANFSV

SEQ ID NO: 740 - protein, 122 aa, Artificial Sequence
  ICOSL v186 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSASLGFQEVLSVEVTLHVAANFSV

SEQ ID NO: 741 - protein, 122 aa, Artificial Sequence
  ICOSL v187 IgV
DTQEKEVRAMVGSDVELSCACPEGSRFDLNDVYVYWQTSESKTVVTYHIPQMSSLEHVDSRYRNRALMSPAGMLRGDFSLRLFNVTPQDEQKFHCLVLSSSLGFQEVLSVEVTLHVAANFSV

SEQ ID NO: 742 - protein, 122 aa, Artificial Sequence
  ICOSL v188 IgV
DTQEKEVRAMVGSDVELSCACPEGSRFDLNDVYVYWQTSESKTVVTYHIPQMSSLEWVDSRYRNRALMSPAGMLRGDFSLRLFNVTPQDEQKFHCLVLSPSLGFQEVLSVEVTLHVAANFSV

SEQ ID NO: 743 - protein, 122 aa, Artificial Sequence
  ICOSL v189 IgV
DTQEKEVRAMVGSDVELSCACPEGSRFDLNDVYVYWQTSESKTVVTYHIPQQSSLEFVDSRYRNRALMSPAGMLRGDFSLRLFNVTPQDEQKFHCLVLSQSLGFQEVLSVEVTLHVAANFSV

SEQ ID NO: 744 - protein, 122 aa, Artificial Sequence
  ICOSL v190 IgV
DTQEKEVRAMVGSDVELSCACPEGSRFDLNDVYVYWQTSESKTVVTYHIPQQSSLESVDSRYRNRALMSPAGMLRGDFSLRLFNVTPQDEQKFHCLVLSASLGFQEVLSVEVTLHVAANFSV

SEQ ID NO: 745 - protein, 122 aa, Artificial Sequence
  ICOSL v191 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSASLGFQEVLSVEVTLHVAANFSV

SEQ ID NO: 746 - protein, 122 aa, Artificial Sequence
  ICOSL v192 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSPSLGFQEVLSVEVTLHVAANFSV

SEQ ID NO: 747 - protein, 122 aa, Artificial Sequence
  ICOSL v193 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSSSLGFQEVLSVEVTLHVAANFSV

SEQ ID NO: 748 - protein, 122 aa, Artificial Sequence
  ICOSL v194 IgV
DTQEKEVRAMVGSDVELSCACPEGSRFDLNDVYVYWQTSESKTVVTYHIPQSSSLEAVDSRYRNRALMSPAGMLRGDFSLRLFNVTPQDEQKFHCLVLSASLGFQEVLSVEVTLHVAANFSV

SEQ ID NO: 749 - protein, 122 aa, Artificial Sequence
  ICOSL v195 IgV
DTQEKEVRAMVGSDVELSCACPEGSRFDLNDVYVYWQTSESKTVVTYHIPQSSSLEHVDSRYRNRALMSPAGMLRGDFSLRLFNVTPQDEQKFHCLVLSESLGFQEVLSVEVTLHVAANFSV

SEQ ID NO: 750 - protein, 122 aa, Artificial Sequence
  ICOSL v196 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSSSLGFQEVLSVEVTLHVAANFSV

SEQ ID NO: 751 - protein, 122 aa, Artificial Sequence
  ICOSL v197 IgV
DTQEKEVRAMVGSDVELSCACPEGSRFDLNDVYVYWQTSESKTVVTYHIPQSSSLEMVDSRYRNRALMSPAGMLRGDFSLRLFNVTPQDEQKFHCLVLSSSLGFQEVLSVEVTLHVAANFSV

SEQ ID NO: 752 - protein, 122 aa, Artificial Sequence
  ICOSL v198 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSSSLGFQEVLSVEVTLHVAANFSV

SEQ ID NO: 753 - protein, 122 aa, Artificial Sequence
  ICOSL v199 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSMSLGFQEVLSVEVTLHVAANFSV

SEQ ID NO: 754 - protein, 122 aa, Artificial Sequence
  ICOSL v200 IgV
DTQEKEVRAMVGSDVELSCACPEGSRFDLNDVYVYWQTSESKTVVTYHIPQSSSLEYVDSRYRNRALMSPAGMLRGDFSLRLFNVTPQDEQKFHCLVLSVSLGFQEVLSVEVTLHVAANFSV

SEQ ID NO: 755 - protein, 122 aa, Artificial Sequence
  ICOSL v201 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSSSLGFQEVLSVEVTLHVAANFSV

SEQ ID NO: 756 - protein, 122 aa, Artificial Sequence
  ICOSL v202 IgV
DTQEKEVRAMVGSDVELSCACPEGSRFDLNDVYVYWQTSESKTVVTYHIPQTSSLEHVDSRYRNRALMSPAGMLRGDFSLRLFNVTPQDEQKFHCLVLSASLGFQEVLSVEVTLHVAANFSV

SEQ ID NO: 757 - protein, 122 aa, Artificial Sequence
  ICOSL v203 IgV
DTQEKEVRAMVGSDVELSCACPEGSRFDLNDVYVYWQTSESKTVVTYHIPQTSSLEYVDSRYRNRALMSPAGMLRGDFSLRLFNVTPQDEQKFHCLVLSASLGFQEVLSVEVTLHVAANFSV

SEQ ID NO: 758 - protein, 122 aa, Artificial Sequence
  ICOSL v204 IgV
DTQEKEVRAMVGSDVELSCACPEGSRFDLNDVYVYWQTSESKTVVTYHIPQVSSLELVDSRYRNRALMSPAGMLRGDFSLRLFNVTPQDEQKFHCLVLSASLGFQEVLSVEVTLHVAANFSV

SEQ ID NO: 759 - protein, 122 aa, Artificial Sequence
  ICOSL v205 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSKSLGFQEVLSVEVTLHVAANFSV

SEQ ID NO: 760 - protein, 122 aa, Artificial Sequence
  ICOSL v206 IgV
DTQEKEVRAMVGSDVELSCACPEGSRFDLNDVYVYWQTSESKTVVTYHIPQKSSLEYVDSRYRNRALMSPAGMLRGDFSLRLFNVTPQDEQKFHCLVLSRSLGFQEVLSVEVTLHVAANFSV

SEQ ID NO: 761 - protein, 122 aa, Artificial Sequence
  ICOSL v207 IgV
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSV

SEQ ID NO: 762 - protein, 122 aa, Artificial Sequence
  ICOSL v208 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSNSLGFQEVLSVEVTLHVAANFSV

SEQ ID NO: 763 - protein, 122 aa, Artificial Sequence
  ICOSL v209 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSPSLGFQEVLSVEVTLHVAANFSV

SEQ ID NO: 764 - protein, 122 aa, Artificial Sequence
  ICOSL v210 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSRSLGFQEVLSVEVTLHVAANFSV

SEQ ID NO: 765 - protein, 122 aa, Artificial Sequence
  ICOSL v211 IgV
DTQEKEVRAMVGSDVELSCACPEGSRFDLNDVYVYWQTSESKTVVTYHIPQRSSLEFVDSRYRNRALMSPAGMLRGDFSLRLFNVTPQDEQKFHCLVLSTSLGFQEVLSVEVTLHVAANFSV

SEQ ID NO: 766 - protein, 122 aa, Artificial Sequence
  ICOSL v212 IgV
DTQEKEVRAMVGSDVELSCACPEGSRFDLNDVYVYWQTSESKTVVTYHIPQRSSLEHVDSRYRNRALMSPAGMLRGDFSLRLFNVTPQDEQKFHCLVLSKSLGFQEVLSVEVTLHVAANFSV

SEQ ID NO: 767 - protein, 122 aa, Artificial Sequence
  ICOSL v213 IgV
DTQEKEVRAMVGSDVELSCACPEGSRFDLNDVYVYWQTSESKTVVTYHIPQRSSLELVDSRYRNRALMSPAGMLRGDFSLRLFNVTPQDEQKFHCLVLSSSLGFQEVLSVEVTLHVAANFSV

SEQ ID NO: 768 - protein, 122 aa, Artificial Sequence
  ICOSL v214 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSKSLGFQEVLSVEVTLHVAANFSV

SEQ ID NO: 769 - protein, 122 aa, Artificial Sequence
  ICOSL v215 IgV
DTQEKEVRAMVGSDVELSCACPEGSRFDLNDVYVYWQTSESKTVVTYHIPQRSSLEWVDSRYRNRALMSPAGMLRGDFSLRLFNVTPQDEQKFHCLVLSQSLGFQEVLSVEVTLHVAANFSV

SEQ ID NO: 770 - protein, 122 aa, Artificial Sequence
  ICOSL v216 IgV
DTQEKEVRAMVGSDVELSCACPEGSRFDLNDVYVYWQTSESKTVVTYHIPQRSSLEYVDSRYRNRALMSPAGMLRGDFSLRLFNVTPQDEQKFHCLVLSRSLGFQEVLSVEVTLHVAANFSV

SEQ ID NO: 771 - protein, 122 aa, Artificial Sequence
  ICOSL v217 IgV
DTQEKEVRAMVGSDVELSCACPEGSRFDLNDVYVYWQTSESKTVVTYHIPQCSSLEEVDSRYRNRALMSPAGMLRGDFSLRLFNVTPQDEQKFHCLVLSSSLGFQEVLSVEVTLHVAANFSV

SEQ ID NO: 772 - protein, 122 aa, Artificial Sequence
  ICOSL v218 IgV
DTQEKEVRAMVGSDVELSCACPEGSRFDLNDVYVYWQTSESKTVVTYHIPQGSSLEPVDSRYRNRALMSPAGMLRGDFSLRLFNVTPQDEQKFHCLVLSDSLGFQEVLSVEVTLHVAANFSV

SEQ ID NO: 773 - protein, 122 aa, Artificial Sequence
  ICOSL v219 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSGSLGFQEVLSVEVTLHVAANFSV

SEQ ID NO: 774 - protein, 122 aa, Artificial Sequence
  ICOSL v220 IgV
DTQEKEVRAMVGSDVELSCACPEGSRFDLNDVYVYWQTSESKTVVTYHIPQGSSLEVVDSRYRNRALMSPAGMLRGDFSLRLFNVTPQDEQKFHCLVLSQSLGFQEVLSVEVTLHVAANFSV

SEQ ID NO: 775 - protein, 122 aa, Artificial Sequence
  ICOSL v221 IgV
DTQEKEVRAMVGSDVELSCACPEGSRFDLNDVYVYWQTSESKTVVTYHIPQLSSLEVVDSRYRNRALMSPAGMLRGDFSLRLFNVTPQDEQKFHCLVLSQSLGFQEVLSVEVTLHVAANFSV

SEQ ID NO: 776 - protein, 122 aa, Artificial Sequence
  ICOSL v222 IgV
DTQEKEVRAMVGSDVELSCACPEGSRFDLNDVYVYWQTSESKTVVTYHIPQPSSLEPVDSRYRNRALMSPAGMLRGDFSLRLFNVTPQDEQKFHCLVLSQSLGFQEVLSVEVTLHVAANFSV

SEQ ID NO: 777 - protein, 122 aa, Artificial Sequence
  ICOSL v223 IgV
DTQEKEVRAMVGSDVELSCACPEGSRFDLNDVYVYWQTSESKTVVTYHIPQPSSLESVDSRYRNRALMSPAGMLRGDFSLRLFNVTPQDEQKFHCLVLSGSLGFQEVLSVEVTLHVAANFSV

SEQ ID NO: 778 - protein, 122 aa, Artificial Sequence
  ICOSL v224 IgV
DTQEKEVRAMVGSDVELSCACPEGSRFDLNDVYVYWQTSESKTVVTYHIPQSSSLELVDSRYRNRALMSPAGMLRGDFSLRLFNVTPQDEQKFHCLVLSGSLGFQEVLSVEVTLHVAANFSV

SEQ ID NO: 779 - protein, 122 aa, Artificial Sequence
  ICOSL v225 IgV
DTQEKEVRAMVGSDVELSCACPEGSRFDLNDVYVYWQTSESKTVVTYHIPQTSSLEKVDSRYRNRALMSPAGMLRGDFSLRLFNVTPQDEQKFHCLVLSPSLGFQEVLSVEVTLHVAANFSV

SEQ ID NO: 780 - protein, 122 aa, Artificial Sequence
  ICOSL v226 IgV
DTQEKEVRAMVGSDVELSCACPEGSRFDLNDVYVYWQTSESKTVVTYHIPQVSSLETVDSRYRNRALMSPAGMLRGDFSLRLFNVTPQDEQKFHCLVLSLSLGFQEVLSVEVTLHVAANFSV

SEQ ID NO: 781 - protein, 122 aa, Artificial Sequence
  ICOSL v227 IgV
DTQEKEVRAMVGSDVELSCACPEGSRFDLNDVYVYWQTSESKTVVTYHIPQNSSLEQVDSRYRNRALMSPAGMLRGDFSLRLFNVTPQDEQKFHCLVLSPSLGFQEVLSVEVTLHVAANFSV

SEQ ID NO: 782 - protein, 111 aa, Artificial Sequence; identical to SEQ ID NO: 200
  ICOSL v4 IgV

SEQ ID NO: 783 - protein, 122 aa, Artificial Sequence
  ICOSL v4 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSQSLGFQEVLSVEVTLHVAANFSV

SEQ ID NO: 784 - protein, 111 aa, Artificial Sequence; identical to SEQ ID NO: 197
  ICOSL v21 IgV

SEQ ID NO: 785 - protein, 111 aa, Artificial Sequence; identical to SEQ ID NO: 209
  ICOSL v24 IgV

SEQ ID NO: 786 - protein, 122 aa, Artificial Sequence
  ICOSL v24 IgV
DTQEKEVRAMVGSDVELSCACPEGSRFDLNDVYVYWQTSESKTVVTYHIPQKSSLENVDSRYRNRALMSPAGMLRGDFSLRLFNVTPQDEQKFHCLVLSQSLGFQEVLSVEVTLHVAANFSV

SEQ ID NO: 787 - protein, 111 aa, Artificial Sequence; identical to SEQ ID NO: 211
  ICOSL v30 IgV

SEQ ID NO: 788 - protein, 122 aa, Artificial Sequence
  ICOSL v30 IgV
DTQEKEVRAMVGSDVELSCACPEGSRFDLNDVYVYWQTSESKTVVTYHIPQSSSLENVDSRYRNRALMSPAGMLQGDFSLRLFNVTPQDEQKFHCLVLSQSLGFQEVLSVEVTLHVAANFSV

SEQ ID NO: 789 - protein, 111 aa, Artificial Sequence; identical to SEQ ID NO: 213
  ICOSL v34 IgV

SEQ ID NO: 790 - protein, 111 aa, Artificial Sequence
  ICOSL v96 IgV
DTQEKEVRAMVGSDVELSCACPEGSRFDLNDVYVYWQTSESKAVVTYHIPQHSSLEYVDSRYRNRALMSPAGMQRGDFSLRLFNVTPQGEQKFHCLVLSQSLGFQEVLSDE

SEQ ID NO: 791 - protein, 111 aa, Artificial Sequence
  ICOSL v45 IgV
DTQEKEVRAMVGSDVELSCACPEGSRFDLNDVYVYWQTSESKTVVTYHIPQHSSLEYVDSSYRNRALMSPAGMLRGDFSLRLFNVTPQDEQKFHCLVLSRSLGFQEVLSDE

SEQ ID NO: 792 - protein, 122 aa, Artificial Sequence
  ICOSL v45 IgV
DTQEKEVRAMVGSDVELSCACPEGSRFDLNDVYVYWQTSESKTVVTYHIPQHSSLEYVDSSYRNRALMSPAGMLRGDFSLRLFNVTPQDEQKFHCLVLSRSLGFQEVLSDEVTLHVAANFSV

SEQ ID NO: 793 - protein, 111 aa, Artificial Sequence
  ICOSL v52 IgV
DTQEKEVRAMVGSDVELSCACPEGSRFDLNDVYVYWQTSESKTVVTYHIPQSSSLENVDSRYRNRALMSPTGMLRGDFSLRLFNVTPQDEQKFHCLVLSQSLGFQEVLSVE

SEQ ID NO: 794 - protein, 111 aa, Artificial Sequence
  ICOSL v54 IgV
DTQEKEVRAMVGSDVELSCACPEGSRFDLNDVYVYWQTSESKTVVTHHIPQSSSLENVDSRYRNRALMSPAGMLRGDFSLRLFNVTPQDEQKFHCLVLSQSLGFQEALSVE

SEQ ID NO: 795 - protein, 111 aa, Artificial Sequence
  ICOSL v56 IgV
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDE

SEQ ID NO: 796 - protein, 122 aa, Artificial Sequence
  ICOSL v56 IgV
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSV

SEQ ID NO: 797 - protein, 111 aa, Artificial Sequence
  ICOSL v57 IgV
DTQEKEVRAMVGSDVELSCACPEGSRFDLNDVYVYWRTSESKTVVTYHIPQHSSLEYVDSRYRNRALMSPAGMLRGDFSLRLFNVTPQDEQKFHCLVLSRSLGFQEVLSNE

SEQ ID NO: 798 - protein, 122 aa, Artificial Sequence
  ICOSL v57 IgV
DTQEKEVRAMVGSDVELSCACPEGSRFDLNDVYVYWRTSESKTVVTYHIPQHSSLEYVDSRYRNRALMSPAGMLRGDFSLRLFNVTPQDEQKFHCLVLSRSLGFQEVLSNEVTLHVAANFSV

SEQ ID NO: 799 - protein, 111 aa, Artificial Sequence; identical to SEQ ID NO: 327
  ICOSL v59 IgV

SEQ ID NO: 800 - protein, 122 aa, Artificial Sequence
  ICOSL v59 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHAAANFSV

SEQ ID NO: 801 - protein, 111 aa, Artificial Sequence
  ICOSL v61 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLNVE

SEQ ID NO: 802 - protein, 122 aa, Artificial Sequence
  ICOSL v61 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLNVEVTLHVAANFSV

SEQ ID NO: 803 - protein, 111 aa, Artificial Sequence
  ICOSL v62 IgV
DTQEKEVRAMVGSDVELRCACPEGSRFDLNDVYVYWQTSESKTVVTYHIPQSSSLENVDSRYRNRALMSPAGMLRGDFSLRLFNVTPQDEQKLHCLVLSQSLGFQEVLSVE

SEQ ID NO: 804 - protein, 122 aa, Artificial Sequence
  ICOSL v62 IgV
DTQEKEVRAMVGSDVELRCACPEGSRFDLNDVYVYWQTSESKTVVTYHIPQSSSLENVDSRYRNRALMSPAGMLRGDFSLRLFNVTPQDEQKLHCLVLSQSLGFQEVLSVEVTLHVAANFSV

SEQ ID NO: 805 - protein, 111 aa, Artificial Sequence
  ICOSL v63 IgV
DTQEKEVRAMVGSDVELSCTCPEGSRFDLNDVYVYWQTSESKTVVTYHIPQDSSLENVDSRYRNRALMSPAGMLRGDFSLRLFNVTPQDEQKFHCLVLSQSLGFQEVLSVE

SEQ ID NO: 806 - protein, 122 aa, Artificial Sequence
  ICOSL v63 IgV
DTQEKEVRAMVGSDVELSCTCPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSV

SEQ ID NO: 807 - protein, 111 aa, Artificial Sequence
  ICOSL v64 IgV
DTQEKEVRAMEGSDVELSCACPEGSRFDLDDVYVYWQTSESKTVVTYHIPQHSSLEYVDSRYRNRALMSPAGMLRGDFSLRLFNVTPQDEQKFECIVFSQSLGFQEVLSVE

SEQ ID NO: 808 - protein, 122 aa, Artificial Sequence
  ICOSL v64 IgV
DTQEKEVRAMEGSDVELSCACPEGSRFDLDDVYVYWQTSESKTVVTYHIPQHSSLEYVDSRYRNRALMSPAGMLRGDFSLRLFNVTPQDEQKFECIVFSQSLGFQEVLSVEVTLHVAANFSV

SEQ ID NO: 809 - protein, 111 aa, Artificial Sequence
  ICOSL v65 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFECIVLSQSLGFQEVLSVE

SEQ ID NO: 810 - protein, 111 aa, Artificial Sequence
  ICOSL v66 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFECIVLSQSLGFQEVLSVE

SEQ ID NO: 811 - protein, 122 aa, Artificial Sequence
  ICOSL v66 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFECIVLSQSLGFQEVLSVEVTLHVAANISV

SEQ ID NO: 812 - protein, 111 aa, Artificial Sequence
  ICOSL v67 IgV
DTQEKEVRAVVGSDVELRCACPEGSRFDLDDVYVYWQTSESKTVVTYHIPQSSSLENVDSRYRNRALMSPAGMLRGDFSLRLFNVTPQDEQKFHCLVLSQSLGFQEVLSVE

SEQ ID NO: 813 - protein, 122 aa, Artificial Sequence
  ICOSL v67 IgV
DTQEKEVRAVVGSDVELRCACPEGSRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANFSV

SEQ ID NO: 814 - protein, 111 aa, Artificial Sequence
  ICOSL v68 IgV
DTQEKEVRAMVGSDVELSCACPEGGRFDLDDVYVYWQTSESKTVVTYHIPQSSSLENVDSRYRNRALMSPAGMLRGDFSLRLFNVTPQDEQKFHCLVLSQSLGFQEVLSVE

SEQ ID NO: 815 - protein, 122 aa, Artificial Sequence
  ICOSL v68 IgV
DTQEKEVRAMVGSDVELSCACPEGGRFDLDDVYVYWQTSESKTVVTYHIPQSSSLENVDSRYRNRALMSPAGMLRGDFSLRLFNVTPQDEQKFHCLVLSQSLGFQEVLSVEVTLHVAANSSV

SEQ ID NO: 816 - protein, 111 aa, Artificial Sequence
  ICOSL v69 IgV
DTQEKEVRAMVGSDVELSCACPEGSRFDLDDVYVYWQTSESKTVVTYHIPQSSSLENVDSRYRNRAPMSPAGMLRGDFSLRLFNVTPQDEQKFHCLVLSKSLGFQEVLSVE

SEQ ID NO: 817 - protein, 122 aa, Artificial Sequence
  ICOSL v69 IgV
DTQEKEVRAMVGSDVELSCACPEGSRFDLDDVYVYWQTSESKTVVTYHIPQSSSLENVDSRYRNRAPMSPAGMLRGDFSLRLFNVTPQDEQKFHCLVLSKSLGFQEVLSVEVTLHVAANFSV

SEQ ID NO: 818 - protein, 122 aa, Artificial Sequence
  ICOSL v70 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLHVTANFSV

SEQ ID NO: 819 - protein, 111 aa, Artificial Sequence
  ICOSL v72 IgV
DTQEKEVRAMVGSDVELSCACPEGGRCDLNDVYVYWQTSESKTVVTYHIPQHSSLEYVDSRYRNRALMSPAGMLRGDFSLRLFNVTPQDEQKFHCLVLSRSLGFQEVLSDE

SEQ ID NO: 820 - protein, 122 aa, Artificial Sequence
  ICOSL v72 IgV
DTQEKEVRAMVGSDVELSCACPEGGRCDLNDVYVYWQTSESKTVVTYHIPQHSSLEYVDSRYRNRALMSPAGMLRGDFSLRLFNVTPQDEQKFHCLVLSRSLGFQEVLSDEVTLHVAANFSV

SEQ ID NO: 821 - protein, 111 aa, Artificial Sequence
  ICOSL v73 IgV
DTQEKEVRAIVGGDVELSCACPEGSRFDLNDVYVYWQTSESKTVVTYHIPQHSSLEYVDSRYRNRALMSPAGMLRGGFSLRLFNVTPQDEQKFHCLVLSQSLGFQEVLSAE

SEQ ID NO: 822 - protein, 122 aa, Artificial Sequence
  ICOSL v73 IgV
DTQEKEVRAIVGGDVELSCACPEGSRFDLNDVYVYWQTSESKTVVTYHIPQHSSLEYVDSRYRNRALMSPAGMLRGGFSLRLFNVTPQDEQKFHCLVLSQSLGFQEVLSAEVTLHVAANFSV

SEQ ID NO: 823 - protein, 111 aa, Artificial Sequence; identical to SEQ ID NO: 821
  ICOSL v74 IgV

SEQ ID NO: 824 - protein, 122 aa, Artificial Sequence; identical to SEQ ID NO: 822
  ICOSL v74 IgV

SEQ ID NO: 825 - protein, 111 aa, Artificial Sequence
  ICOSL v75 IgV
DTQEKEVRAMVGSDVELSCACPEGSRFDLNDVYVYWQTSESKTVVTYHIPQHSSLEYVDSCFRNRALMSPAGMLRGDFSLRLFNVTPQDEQKFHCLVLSRSLGFQEVLSNE

SEQ ID NO: 826 - protein, 122 aa, Artificial Sequence
  ICOSL v75 IgV
DTQEKEVRAMVGSDVELSCACPEGSRFDLNDVYVYWQTSESKTVVTYHIPQHSSLEYVDSCFRNRALMSPAGMLRGDFSLRLFNVTPQDEQKFHCLVLSRSLGFQEVLSNEVTLHVAANSSV

SEQ ID NO: 827 - protein, 122 aa, Artificial Sequence
  ICOSL v76 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSV

SEQ ID NO: 828 - protein, 111 aa, Artificial Sequence; identical to SEQ ID NO: 327
  ICOSL v81 IgV

SEQ ID NO: 829 - protein, 122 aa, Artificial Sequence; identical to SEQ ID NO: 563
  ICOSL v81 IgV

SEQ ID NO: 830 - protein, 111 aa, Artificial Sequence
  ICOSL v84 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSDE

SEQ ID NO: 831 - protein, 122 aa, Artificial Sequence
  ICOSL v84 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSDEVTLRVAANFSV

SEQ ID NO: 832 - protein, 111 aa, Artificial Sequence
  ICOSL v92 IgV
DTQEKEVRAMVGSDVELSCACPEGSRFDLNDVYVYWQTSESKTVVTYHIPQHSSLEYVDSRYRNRALMSPAGMQRGDFSLRLFNVTPQDEQKFHCLVLSQSLGFQEVLSDE

SEQ ID NO: 833 - protein, 122 aa, Artificial Sequence; identical to SEQ ID NO: 587
  ICOSL v92 IgV

SEQ ID NO: 834 - protein, 122 aa, Artificial Sequence
  ICOSL v96 IgV
DTQEKEVRAMVGSDVELSCACPEGSRFDLNDVYVYWQTSESKAVVTYHIPQHSSLEYVDSRYRNRALMSPAGMQRGDFSLRLFNVTPQGEQKFHCLVLSQSLGFQEVLSDEVTLHVAANFSV

SEQ ID NO: 835 - protein, 111 aa, Artificial Sequence
  ICOSL v98 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEILSDE

SEQ ID NO: 836 - protein, 122 aa, Artificial Sequence
  ICOSL v98 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEILSDEVTLHVAANFSV

SEQ ID NO: 837 - protein, 111 aa, Artificial Sequence
  ICOSL v103 IgV
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVE

SEQ ID NO: 838 - protein, 122 aa, Artificial Sequence
  ICOSL v103 IgV
DTQEKEVRAMVGSDVELSCACPEGSRFDLNDVYVYWQTSESKTVVTYHIPQQSSLENVDSRYRNRALMSPAGMLRGDFSLRLFNVTPQDEQKFHCLVLSQSLGFQEVLSVEVTLHVAANFSV

SEQ ID NO: 839 - protein, 111 aa, Artificial Sequence
  ICOSL v126 IgV
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVE

SEQ ID NO: 840 - protein, 122 aa, Artificial Sequence; identical to SEQ ID NO: 588
  ICOSL v106 IgV

SEQ ID NO: 841 - protein, 122 aa, Artificial Sequence
  ICOSL v127 IgV
DTQEKEVRAMVGSDVELSCACPEGSRFDLNDVYVYWQTSESKTVVTYHIPQHSSLENVDSRYRNRALMSPAGMLRGDFSLRLFQVTPQDEQKFHCLVLSQSLGFQEVLSVEVTLHVAANFSV

SEQ ID NO: 842 - protein, 122 aa, Artificial Sequence; identical to SEQ ID NO: 589
  ICOSL v108 IgV

SEQ ID NO: 843 - protein, 122 aa, Artificial Sequence
  ICOSL v129 IgV
DTQEKEVRAMVGSDVELSCACPEGSRFDLNDVYVYWQTSESKTVVTYHIPQQSSLENVDSRYRNRALMSPAGMLRGDFSLRLFQVTPQDEQKFHCLVLSQSLGFQEVLSVEVTLHVAAQFSV

SEQ ID NO: 844 - protein, 111 aa, Artificial Sequence
  ICOSL v140 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSRSLGFQEVLSVE

SEQ ID NO: 845 - protein, 122 aa, Artificial Sequence
  ICOSL v140 IgV
DTQEKEVRAMVGSDVELSCACPEGSRFDLNDVYVYWQTSESKTVVTYHIPQNSSLEYVDSRYRNRALMSPAGMLRGDFSLRLFNVTPQDEQKFHCLVLSRSLGFQEVLSVEVTLHVAANFSV

SEQ ID NO: 846 - protein, 111 aa, Artificial Sequence; identical to SEQ ID NO: 434
  ICOSL v142 IgV

SEQ ID NO: 847 - protein, 122 aa, Artificial Sequence; identical to SEQ ID NO: 594
  ICOSL v142 IgV

SEQ ID NO: 848 - protein, 122 aa, Artificial Sequence
  ICOSL v177 IgV
  VARIANT (115)..(115): x is H or Q
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLXVAANFSV

SEQ ID NO: 849 - protein, 111 aa, Artificial Sequence
  ICOSL v148 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSVE

SEQ ID NO: 850 - protein, 122 aa, Artificial Sequence
  ICOSL v148 IgV
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSRGFQEVLSVEVTLRVAANFSV

SEQ ID NO: 851 - protein, 122 aa, Artificial Sequence
  ICOSL v149 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSQSLGFQEVLSVEVTLHVAANFSA

SEQ ID NO: 852 - protein, 122 aa, Artificial Sequence
  ICOSL v158 IgV
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLRVAANFSV

SEQ ID NO: 853 - protein, 122 aa, Artificial Sequence
  ICOSL v169 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANFSV

SEQ ID NO: 854 - protein, 111 aa, Artificial Sequence
  ICOSL v160 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSPSLGFQEVLSVE

SEQ ID NO: 855 - protein, 122 aa, Artificial Sequence
  ICOSL v160 IgV
DTQEKEVRAMVGSDVELSCACPEGSRFDLNDVYVYWQTSESKTVVTYHIPQYSSLEYVDSRYRNRALMSPAGMLRGDFSLRLFNVTPQDEQKFHCLVLSPSLGFQEVLSVEVTLHVAANFSV

SEQ ID NO: 856 - protein, 111 aa, Artificial Sequence; identical to SEQ ID NO: 340
  ICOSL v164 IgV

SEQ ID NO: 857 - protein, 122 aa, Artificial Sequence
  ICOSL v168 IgV
DTQEKEVRAMVGSDVELSCACPEGSRFDLNDVYVYWQTSESKTVVTYHIPQSSSLENVDSRYRNRALMSPAGMLRGDFSLRLFNVTPQDEQKFHCLVLSQSLGFQEVLSVEVTLRVAANSSV

SEQ ID NO: 858 - protein, 237 aa, Artificial Sequence
  eGFP
SKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 859 - protein, 237 aa, Artificial Sequence
  Green fluorescent protein
SKGEELFTGVVPILVELDGDVNGHKFSVSGEGEGDATYGKLTLKFICTTGKLPVPWPTLVTTFSYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYK

SEQ ID NO: 860 - protein, 20 aa, Artificial Sequence
  T2A protein
SGEGRGSLLTCGDVEENPGP

SEQ ID NO: 861 - protein, 21 aa, Artificial Sequence
  T2A protein
GSGEGRGSLLTCGDVEENPGP

SEQ ID NO: 862 - protein, 18 aa, Artificial Sequence
  T2A protein
EGRGSLLTCGDVEENPGP

SEQ ID NO: 863 - protein, 22 aa, Artificial Sequence
  P2A protein
GSGATNFSLLKQAGDVEENPGP

SEQ ID NO: 864 - protein, 6 aa, Artificial Sequence
  His tag
HHHHHH

SEQ ID NO: 865 - protein, 8 aa, Artificial Sequence
  Flag tag
DYKDDDDK

SEQ ID NO: 866 - protein, 448 aa, Artificial Sequence
  Atezolizumab Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 867 - protein, 214 aa, Artificial Sequence
  Atezolizumab Light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 868 - protein, 580 aa, Artificial Sequence
  ICOSL WT IgV - Atezolizumab HC
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 869 - protein, 580 aa, Artificial Sequence
  ICOSL v56 IgV - Atezolizumab HC
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 870 - protein, 580 aa, Artificial Sequence
  ICOSL v39 IgV - Atezolizumab HC
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 871 - protein, 346 aa, Artificial Sequence
  ICOSL WT IgV - Atezolizumab LC
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 872 - protein, 346 aa, Artificial Sequence
  ICOSL v56 IgV - Atezolizumab LC
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 873 - protein, 346 aa, Artificial Sequence
  ICOSL v39 IgV - Atezolizumab LC
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 874 - protein, 580 aa, Artificial Sequence
  Atezolizumab HC - ICOSL WT IgV
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 875 - protein, 580 aa, Artificial Sequence
  Atezolizumab HC - ICOSL v56 IgV
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSV

SEQ ID NO: 876 - protein, 580 aa, Artificial Sequence
  Atezolizumab HC - ICOSL v39 IgV
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSV

SEQ ID NO: 877 - protein, 346 aa, Artificial Sequence
  Atezolizumab LC - ICOSL WT IgV
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSV

SEQ ID NO: 878 - protein, 346 aa, Artificial Sequence
  Atezolizumab LC - ICOSL v56 IgV
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSV

SEQ ID NO: 879 - protein, 346 aa, Artificial Sequence
  Atezolizumab LC - ICOSL v39 IgV
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSV

SEQ ID NO: 880 - protein, 696 aa, Artificial Sequence
  ICOSL WT ECD - Atezolizumab HC
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 881 - protein, 696 aa, Artificial Sequence
  ICOSL v56 ECD - Atezolizumab HC
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAATGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 882 - protein, 696 aa, Artificial Sequence
  ICOSL v39 ECD - Atezolizumab HC
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 883 - protein, 462 aa, Artificial Sequence
  ICOSL WT ECD - Atezolizumab LC
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 884 - protein, 462 aa, Artificial Sequence
  ICOSL v56 ECD - Atezolizumab LC
DTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAATGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 885 - protein, 462 aa, Artificial Sequence
  ICOSL v39 ECD - Atezolizumab LC
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 886 - protein, 696 aa, Artificial Sequence
  Atezolizumab HC - ICOSL WT ECD
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 887 - protein, 696 aa, Artificial Sequence
  Atezolizumab HC - ICOSL v56 ECD
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAAT

SEQ ID NO: 888 - protein, 696 aa, Artificial Sequence
  Atezolizumab HC - ICOSL v39 ECD
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 889 - protein, 462 aa, Artificial Sequence
  Atezolizumab LC - ICOSL WT ECD
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 890 - protein, 462 aa, Artificial Sequence
  Atezolizumab LC - ICOSL v56 ECD
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVVLSCACPEGSRFDLNDVYVYWQTSESKTVVTYHIPQHSSLEYVDSRYRNRALMSPAGMLRGDFSLRLFNVTPQDEQKFHCLVLSRSLGFQEVLSDEVTLRVAANFSVPVVSAPHSPSQDELTFTCTSINGYPRPNVCWINMTDNSLLDQALQNDTVFLNMRGLYDVVSVLRIARTPSVNIGCRIENVLLQQNLTVGSQTGNDIGERDKITENPVSTGEKNAAT

SEQ ID NO: 891 - protein, 462 aa, Artificial Sequence
  Atezolizumab LC - ICOSL v39 ECD
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAAT

SEQ ID NO: 892 - protein, 582 aa, Artificial Sequence
  ICOSL v5 IgV - Atezolizumab HC
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 893 - protein, 580 aa, Artificial Sequence
  Atezolizumab HC - ICOSL v5 IgV
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSV

SEQ ID NO: 894 - protein, 348 aa, Artificial Sequence
  ICOSL v5 IgV - Atezolizumab LC
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSVGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 895 - protein, 346 aa, Artificial Sequence
  Atezolizumab LC - ICOSL v5 IgV
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECGGGGSGGGGSDTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSPSLGFQEVLSVEVTLHVAANFSV

SEQ ID NO: 896 - protein, 239 aa, Artificial Sequence
  eGFP
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 897 - protein, 68 aa, Artificial Sequence
  CD8 hinge and transmembrane domain
KPTTTPAPRPPTPAPTIASQPLSLRPEACRPAAGGAVHTRGLDFACDIYIWAPLAGTCGVLLLSLVIT

SEQ ID NO: 898 - protein, 431 aa, Artificial Sequence
  antiCD19 chimeric antigen receptor CAR-2
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 899 - protein, 707 aa, Artificial Sequence
  antiCD19 chimeric antigen receptor CAR-2
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEASRPAAGGAVHTRGLDFASDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLGWEAFTETLYPADGGLEGRNDMALKLVGGSHLIANIKTTYRSKKPAKNLKMPGVYYVDYRLERIKEANNETYVEQHEVAVARYCDLPSKLGHKLN

SEQ ID NO: 900 - DNA, 8708 bp, Artificial Sequence
  anti-CD19 chimeric antigen receptor CAR-2
agcttaatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacaataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcctcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaaattcaaaattttatcgatcacgagactagcctcgagaagcttgatatcgaattcccacggggttggacgcgtaggaacagagaaacaggagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctctatataagcagagctcgtttagtgaaccgtcagatcgcctggagacgccatccacgctgttttgacttccatagaaggatcccctgcaggtaatacgactcactatagggtccactgccgccaccatggctctgcctgtgacagctctgctgctgcctctggccctgctgctccatgccgccagacccggatccgatatccagatgacccagaccaccagcagcctgagcgccagcctgggcgatagagtgaccatcagctgcagagccagccaggacatcagcaagtacctgaactggtatcagcagaaacccgacggcaccgtgaagctgctgatctaccacaccagcagactgcacagcggcgtgcccagcagattttctggcagcggctccggcaccgactacagcctgaccatctccaacctggaacaggaagatatcgctacctacttctgtcagcaaggcaacaccctgccctacaccttcggcggaggcaccaagctggaaatcaccggcagcacaagcggcagcggcaagcctggatctggcgagggaagcaccaagggcgaagtgaaactgcaggaaagcggccctggactggtggccccaagccagtctctgagcgtgacctgtaccgtgtccggcgtgtccctgcctgactatggcgtgtcctggatcagacagccacccagaaagggcctggaatggctgggagtgatctggggcagcgagacaacctactacaacagcgccctgaagtcccggctgaccatcatcaaggacaactccaagagccaggtgttcctgaagatgaacagcctgcagaccgacgacaccgccatctactactgcgccaagcactactactacggcggcagctacgccatggactactggggccagggcacaagcgtgaccgtgtccagcgctagcgccaagcccaccacgacgccagcgccgcgaccaccaacaccggcgcccaccatcgcgtcgcagcccctgtccctgcgcccagaggcgagccggccagcggcggggggcgcagtgcacacgagggggctggacttcgccagtgatatctacatctgggcgcccctggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagtggcgagggcagaggaagtctgctaacatgcggtgacgtggaggagaatccgggcccctctagaagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaattgagtcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccagttccgcccattctccgccccatggctgactaattttttttatttatgcagaggccgaggccgcctcggcctctgagctattccagaagtagtgaggaggcttttttggaggcctaggcttttgcgtcgagacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgca

SEQ ID NO: 901 - protein, 428 aa, Artificial Sequence
  antiCD19 chimeric antigen receptor CAR-1
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 902 - protein, 706 aa, Artificial Sequence
  antiCD19 chimeric antigen receptor CAR-1
MALPVTALLLPLALLLHAARPGSDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGSTSGSGKPGSGEGSTKGEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSASAKPTTTPAPRPPTPAPTIASQPLSLRPEACRPAAGGAVHTRGLDFACDIYIWAPLAGTCGVLLLSLVITRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGGRSGEGRGSLLTCGDVEENPGPSRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 903 - protein, 232 aa, Artificial Sequence
  Blue fluorescent protein
SRSELIKENMHMKLYMEGTVDNHHFKCTSEGEGKPYEGTQTMRIKVVEGGPLPFAFDILATSFLYGSKTFINHTQGIPDFFKQSFPEGFTWERVTTYEDGGVLTATQDTSLQDGCLIYNVKIRGVNFTSNGPVMQKKTLWEAFTETLYPADGGLEGRNDMALKLVGGSHLIANIKTTYRSKKPAKNLKMPGVYYVDYRLERIKEANNETYVEQHEVAARYCDLPSKLGHKLN

SEQ ID NO: 904 - protein, 400 aa, Artificial Sequence
  PAS
ASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPAASPAAPAPASPAAPAPSAPA

SEQ ID NO: 905 - protein, 238 aa, Artificial Sequence
  ICOSL v228 ECD
DTQEKEVRAMVGSDVELSCACPEGSRFDLNDVYVYWQTSESKTVVTYHIPQNSFLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSANIGCCIENVLLQQNLTVGSQTGNDIGERDKITENPVSTGEKNAAT

SEQ ID NO: 906 - protein, 111 aa, Artificial Sequence
  ICOSL v228 IgV
DTQEKEVRAMVGSDVELSCACPEGSRFDLNDVYVYWQTSESKTVVTYHIPQNSFLENVDSRYRNRALMSPAGMLRGDFSLRLFNVTPQDEQKFHCLVLSQSLGFQEVLSVE

SEQ ID NO: 907 - protein, 122 aa, Artificial Sequence
  ICOSL v228 IgV
DTQEKEVRAMVGSDVELSCACPEGSRFDLNDVYVYWQTSESKTVVTYHIPQNSFLENVDSRYRNRALMSPAGMLRGDFSLRLFNVTPQDEQKFHCLVLSQSLGFQEVLSVEVTLHVAANFSV

SEQ ID NO: 908 - protein, 238 aa, Artificial Sequence
  ICOSL v229 ECD
DTQEKEVRAMVGSDVELSCACPEGSSFDLNDVYVYWQTSESKTVVTYHIPQHSSLEYVDSRYRNRALMSPAGMLRGDFSLRLFNVTPQDEQKFHCLVLSQSLGFQEVLSDEVTLHVAANFSVPVVSAPHSPSQDELAFTCTSINGYPRPNVYWINKTDNSLLDQALQNDTVFLNMRGLYDVVSVLRIARTPSVNIGCRIENVLLQQNLTVGSQTGNDIGERDKITENPVSTGEKNAAT

SEQ ID NO: 909 - protein, 111 aa, Artificial Sequence
  ICOSL v229 IgV
DTQEKEVRAMVGSDVELSCACPEGSSFDLNDVYVYWQTSESKTVVTYHIPQHSSLEYVDSRYRNRALMSPAGMLRGDFSLRLFNVTPQDEQKFHCLVLSQSLGFQEVLSDE

SEQ ID NO: 910 - protein, 122 aa, Artificial Sequence
  ICOSL v229 IgV
DTQEKEVRAMVGSDVELSCACPEGSSFDLNDVYVYWQTSESKTVVTYHIPQHSSLEYVDSRYRNRALMSPAGMLRGDFSLRLFNVTPQDEQKFHCLVLSQSLGFQEVLSDEVTLHVAANFSV

SEQ ID NO: 911 - DNA, 1530 bp, Artificial Sequence
  ICOSL/NKp30 Stack 1
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacaggacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 912 - protein, 491 aa, Artificial Sequence
  ICOSL/NKp30 Stack 1
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 913 - DNA, 1923 bp, Artificial Sequence
  ICOSL/NKp30 Stack 2
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacaggacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccaatccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggtggaggaggtagcgggggaggaggcagcggtggtggcgggtcattgtgggtttcacagcctccagaaatacggaccctcgagggttcctctgcttttctgccctgtagctttaatgcttctcagggacgcgtggctattggctccgttacgtggtttcgggacgaggtggtccctgggaaggaggtacggaatggaacacctgagtttcggggccgcctcgttccgctcgctccaagccgcttccttcacgaccaccaagcggaacttcatataagggacgtgagggggcatgacgcgggtatatatgtctgccgcgtcgaggtgctgggtcttggggtgggtacgggcaatggcacccgattggtcgttgagaaagaacaccctcagctgggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 914 - protein, 622 aa, Artificial Sequence
  ICOSL/NKp30 Stack 2
DTQEKEVRAMVGSDVELSCACPEGSRFDLNDVYVYWQTSESKTVVTYHIPQDSSLENVDSRYRNRALMSPAGMLRGDFSLRLFNVTPQDEQKFHCLVLSQSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 915 - DNA, 1530 bp, Artificial Sequence
  ICOSL/NKp30 Stack 3
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 916 - protein, 491 aa, Artificial Sequence
  ICOSL/NKp30 Stack 3
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 917 - DNA, 1923 bp, Artificial Sequence
  ICOSL/NKp30 Stack 4
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagcacagctccttggaaaacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggtggaggaggtagcgggggaggaggcagcggtggtggcgggtcattgtgggtttcacagcctccagaaatacggaccctcgagggttcctctgcttttctgccctgtagctttaatgcttctcagggacgcgtggctattggctccgttacgtggtttcgggacgaggtggtccctgggaaggaggtacggaatggaacacctgagtttcggggccgcctcgttccgctcgctccaagccgcttccttcacgaccaccaagcggaacttcatataagggacgtgagggggcatgacgcgggtatatatgtctgccgcgtcgaggtgctgggtcttggggtgggtacgggcaatggcacccgattggtcgttgagaaagaacaccctcagctgggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 918 - protein, 622 aa, Artificial Sequence
  ICOSL/NKp30 Stack 4
DTQEKEVRAMVGSDVELSCACPEGSRFDLNDVYVYWQTSESKTVVTYHIPQHSSLENVDSRYRNRALMSPAGMLRGDFSLRLFNVTPQDEQKFHCLVLSRSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 919 - DNA, 1530 bp, Artificial Sequence
  ICOSL/NKp30 Stack 5
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaagaccgtggtgacctaccacatcccacagcacagctccttggaatacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 920 - protein, 491 aa, Artificial Sequence
  ICOSL/NKp30 Stack 5
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 921 - DNA, 1923 bp, Artificial Sequence
  ICOSL/NKp30 Stack 6
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaagaccgtggtgacctaccacatcccacagcacagctccttggaatacgtggacagccgctaccggaaccgagccctgatgtcaccggccggcatgctgcggggcgacttctccctgcgcttgttcaacgtcaccccccaggacgagcagaagtttcactgcctggtgttgagccgatccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggtggaggaggtagcgggggaggaggcagcggtggtggcgggtcattgtgggtttcacagcctccagaaatacggaccctcgagggttcctctgcttttctgccctgtagctttaatgcttctcagggacgcgtggctattggctccgttacgtggtttcgggacgaggtggtccctgggaaggaggtacggaatggaacacctgagtttcggggccgcctcgttccgctcgctccaagccgcttccttcacgaccaccaagcggaacttcatataagggacgtgagggggcatgacgcgggtatatatgtctgccgcgtcgaggtgctgggtcttggggtgggtacgggcaatggcacccgattggtcgttgagaaagaacaccctcagctgggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 922 - protein, 622 aa, Artificial Sequence
  ICOSL/NKp30 Stack 6
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 923 - DNA, 1530 bp, Artificial Sequence
  ICOSL/NKp30 Stack 7
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagctgagctccttggaacatgtggacagccgctaccggaaccgagccctgatgtcaccggccggcatgctgcggggcgacttctccctgcgcttgttcaacgtcaccccccaggacgagcagaagtttcactgcctggtgttgagccggtccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 924 - protein, 491 aa, Artificial Sequence
  ICOSL/NKp30 Stack 7
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 925 - DNA, 1923 bp, Artificial Sequence
  ICOSL/NKp30 Stack 8
atggggtcaaccgccatcctcgccctcctcctggctgttctccaaggagtcagcgctgatactcaggagaaggaagtcagagcgatggtaggcagcgacgtggagctcagctgcgcttgccctgaaggaagccgttttgatttaaatgatgtttacgtatattggcaaaccagtgagtcgaaaaccgtggtgacctaccacatcccacagctgagctccttggaacatgtggacagccgctaccggaaccgagccctgatgtcaccggccggcatgctgcggggcgacttctccctgcgcttgttcaacgtcaccccccaggacgagcagaagtttcactgcctggtgttgagccggtccctgggattccaggaggttttgagcgttgaggttacactgcatgtggcagcaaacttcagcgtgggaggtggtggatcaggcggtggaggttccggaggaggtggatctctctgggtgtcccagccccctgagattcgtaccctggaaggatcctctgccttcctgccctgctccttcaatgccagccaagggagagtggccattggctccgtcacgtggttccgagatgaggtggttccagggaaggaggtgaggaatggaaccccagagttcaggggccgcctggtcccacttgctccctcccgtttcctccatgaccaccaggctgagctgcacatccgggacgtgcgaggccatgacgccggtatctacgtgtgcagagtggaggtgctgggccttggtgtcgggacagggaatgggactcggctggtggtggagaaagaacatcctcagctaggtggaggaggtagcgggggaggaggcagcggtggtggcgggtcattgtgggtttcacagcctccagaaatacggaccctcgagggttcctctgcttttctgccctgtagctttaatgcttctcagggacgcgtggctattggctccgttacgtggtttcgggacgaggtggtccctgggaaggaggtacggaatggaacacctgagtttcggggccgcctcgttccgctcgctccaagccgcttccttcacgaccaccaagcggaacttcatataagggacgtgagggggcatgacgcgggtatatatgtctgccgcgtcgaggtgctgggtcttggggtgggtacgggcaatggcacccgattggtcgttgagaaagaacaccctcagctgggatccggtggaggagggtcagagcccaaaagctccgacaagactcacacatgccccccttgtccagcgcctgaagctgagggtgcgccctctgtcttccttttcccccctaagccgaaagataccctgatgatctcccgcactcccgaagtcacatgtgttgttgtcgacgtatctcatgaagatcctgaggtgaaattcaactggtatgtagacggggtcgaagttcataatgctaagactaagccacgagaagagcaatacaactcaacgtatcgggtggtgagcgttctgacggttctgcaccaagattggcttaatggaaaagagtataagtgcaaggtgtccaacaaggctcttccggcacccatcgaaaagacgatttccaaagcgaaaggccaacctagggaaccgcaagtttacactttgcccccgtcaagagacgaacttaccaagaatcaagtttccctgacgtgccttgtgaagggcttctaccctagcgatatagcagttgagtgggaatctaacggccagcccgaaaataattataagactactccgcccgtgctggacagtgatggttcatttttcctgtattcaaaactcactgtggacaaatctagatggcagcagggtaatgtgttctcttgttcagttatgcacgaggcattgcacaatcactatacgcaaaaaagtttgtctctctctccgggg

SEQ ID NO: 926 - protein, 622 aa, Artificial Sequence
  ICOSL/NKp30 Stack 8
DTQEKEVRAMVGSDVELSCACPEGSRFDLNDVYVYWQTSESKTVVTYHIPQLSSLEHVDSRYRNRALMSPAGMLRGDFSLRLFNVTPQDEQKFHCLVLSRSLGFQEVLSVEVTLHVAANFSVGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGGGGSGGGGSGGGGSLWVSQPPEIRTLEGSSAFLPCSFNASQGRVAIGSVTWFRDEVVPGKEVRNGTPEFRGRLVPLAPSRFLHDHQAELHIRDVRGHDAGIYVCRVEVLGLGVGTGNGTRLVVEKEHPQLGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 927 - protein, 231 aa, Artificial Sequence
  Fc with C220S/E356D/M358L/K447del
EPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 928 - protein, 363 aa, Artificial Sequence
  Variant ICOSL IgV-Fc
DTQEKEVRAMVGSDVELSCACPEGSRFDLNDVYVYWQTSESKTVVTYHIPQHSSLEYVDSRYRNRALMSPAGMLRGDFSLRLFNVTPQDEQKFHCLVLSRSLGFQEVLSVEVTLHVAANFSVGGGGSGGGGSEPKSSDKTHTCPPCPAPEAEGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 929 - protein, 116 aa, Artificial Sequence
  NKp30 WT IgV-like
LWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQL

SEQ ID NO: 930 - protein, 116 aa, Artificial Sequence
  NKp30 v2 IgV-like
LWVSQPPEIRTLEGSSAFLPCSFNASQGRVAIGSVTWFRDEVVPGKEVRNGTPEFRGRLAPLASSRFLHDHQAELHIRDVRGHDASIYVCRVEVLGLGVGTGNGTRLVVEKEHPQL

SEQ ID NO: 931 - protein, 116 aa, Artificial Sequence
  NKp30 v3 IgV-like
LWVSQPPEIRTLEGSSAFLPCSFNASQGRLAIGSVTWFRDEVVPGKEVRNGTPEFRGRLVPLASSRFLHDHQAELHIRDVRGHDASIYVCRVEVLGLGVGTGNGTRLVVEKEHPQL

SEQ ID NO: 932 - protein, 116 aa, Artificial Sequence
  NKp30 v4 IgV-like
LWVSQPPEIRTLEGSSAFLPCSFNASQGRLAIGSVTWFRDEVVPGKEVRNGTPEFRGRLAPLAPSRFLHDHQAELHIRDVRGHDASIYVCRVEVLGLGVGTGNGTRLVVEKEHPQL

SEQ ID NO: 933 - protein, 116 aa, Artificial Sequence
  NKp30 v5 IgV-like
LWVSQPPEIRTLEGSSAFLPCSFNASQGRLAIGSVTWFRDEVVPGKEVRNGTPEFRGRLAPLASSRFLHDHQAELHIRDVRGHDAGIYVCRVEVLGLGVGTGNGTRLVVEKEHPQL

What is claimed:

1. A variant ICOSL-Fc fusion protein set forth in SEQ ID NO:928.

2. A variant ICOSL-Fc fusion protein homodimer, wherein each polypeptide of the homodimer is set forth in SEQ ID NO:928.

3. A pharmaceutical composition comprising a variant ICOSL-Fc fusion protein of claim 1, and a pharmaceutically acceptable excipient.

4. A pharmaceutical composition comprising a variant ICOSL-Fc fusion protein homodimer of claim 2, and a pharmaceutically acceptable excipient.

* * * * *